US011713358B2

(12) United States Patent
Schellenberger et al.

(10) Patent No.: US 11,713,358 B2
(45) Date of Patent: Aug. 1, 2023

(54) CHIMERIC POLYPEPTIDE ASSEMBLY AND METHODS OF MAKING AND USING THE SAME

(71) Applicant: AMUNIX PHARMACEUTICALS, INC., South San Francisco, CA (US)

(72) Inventors: Volker Schellenberger, Palo Alto, CA (US); Fan Yang, San Jose, CA (US); Desiree Thayer, Burlingame, CA (US); Bee-Cheng Sim, Mountain View, CA (US); Chia-Wei Wang, Santa Clara, CA (US)

(73) Assignee: AMUNIX PHARMACEUTICALS, INC., South San Francisco, CA (US)

( * ) Notice: Subject to any disclaimer, the term of this patent is extended or adjusted under 35 U.S.C. 154(b) by 494 days.

(21) Appl. No.: 15/753,716

(22) PCT Filed: Aug. 26, 2016

(86) PCT No.: PCT/US2016/049137
§ 371 (c)(1),
(2) Date: Feb. 20, 2018

(87) PCT Pub. No.: WO2017/040344
PCT Pub. Date: Mar. 9, 2017

(65) Prior Publication Data
US 2019/0153115 A1    May 23, 2019

Related U.S. Application Data

(60) Provisional application No. 62/379,673, filed on Aug. 25, 2016, provisional application No. 62/363,046, filed on Jul. 15, 2016, provisional application No. 62/338,285, filed on May 18, 2016, provisional application No. 62/278,755, filed on Jan. 14, 2016, provisional application No. 62/263,319, filed on Dec. 4, 2015, provisional application No. 62/211,532, filed on Aug. 28, 2015.

(51) Int. Cl.
| | |
|---|---|
| *C07K 16/30* | (2006.01) |
| *C07K 16/28* | (2006.01) |
| *A61P 35/00* | (2006.01) |
| *C07K 14/00* | (2006.01) |
| *A61K 39/00* | (2006.01) |
| *A61K 38/00* | (2006.01) |

(52) U.S. Cl.
CPC .............. *C07K 16/30* (2013.01); *A61P 35/00* (2018.01); *C07K 14/00* (2013.01); *C07K 16/2809* (2013.01); *A61K 38/00* (2013.01); *A61K 2039/505* (2013.01); *A61K 2039/54* (2013.01); *A61K 2039/545* (2013.01); *A61K 2039/572* (2013.01); *C07K 2317/24* (2013.01); *C07K 2317/31* (2013.01); *C07K 2317/56* (2013.01); *C07K 2317/565* (2013.01); *C07K 2317/60* (2013.01); *C07K 2317/622* (2013.01); *C07K 2317/73* (2013.01); *C07K 2317/732* (2013.01); *C07K 2317/76* (2013.01); *C07K 2317/90* (2013.01); *C07K 2317/92* (2013.01); *C07K 2317/94* (2013.01); *C07K 2319/01* (2013.01); *C07K 2319/035* (2013.01); *C07K 2319/21* (2013.01); *C07K 2319/30* (2013.01); *C07K 2319/31* (2013.01); *C07K 2319/50* (2013.01)

(58) Field of Classification Search
None
See application file for complete search history.

(56) References Cited

U.S. PATENT DOCUMENTS

| | | |
|---|---|---|
| 4,398,908 A | 8/1983 | Siposs et al. |
| 4,435,173 A | 3/1984 | Siposs et al. |
| 4,753,894 A | 6/1988 | Frankel et al. |
| 4,933,185 A | 6/1990 | Wheatley et al. |
| 4,943,533 A | 7/1990 | Mendelsohn et al. |
| 4,976,696 A | 12/1990 | Sanderson et al. |
| 4,988,337 A | 1/1991 | Ito |
| 5,017,378 A | 5/1991 | Turner et al. |
| 5,176,502 A | 1/1993 | Becton et al. |
| 5,270,176 A | 12/1993 | Doerschug et al. |
| 5,298,022 A | 3/1994 | Bernardi et al. |
| 5,318,540 A | 6/1994 | Athayde et al. |
| 5,492,534 A | 2/1996 | Athayde et al. |
| 5,599,907 A | 2/1997 | Anderson et al. |

(Continued)

FOREIGN PATENT DOCUMENTS

| | | |
|---|---|---|
| AU | 2008234019 A1 | 10/2008 |
| EP | 0036776 A2 | 9/1981 |

(Continued)

OTHER PUBLICATIONS

Malia et al (Proteins, 84;427-434, 2016).*

(Continued)

*Primary Examiner* — Brad Duffy
(74) *Attorney, Agent, or Firm* — Lathrop GPM LLP; James H. Velema, Esq.

(57) ABSTRACT

The present invention relates to bispecific chimeric polypeptide assembly compositions comprising bulking moieties linked to binding domains by cleavable release segments that, when cleaved are capable of concurrently binding effector T cells with targeted tumor or cancer cells and effecting cytolysis of the tumor cells or cancer cells. The invention also provides compositions and methods of making and using the cleavable chimeric polypeptide assembly compositions.

72 Claims, 60 Drawing Sheets
Specification includes a Sequence Listing.

(56) References Cited

U.S. PATENT DOCUMENTS

| | | | |
|---|---|---|---|
| 5,677,171 A | 10/1997 | Hudziak et al. | |
| 5,736,137 A | 4/1998 | Anderson et al. | |
| 5,821,337 A | 10/1998 | Carter et al. | |
| 5,891,996 A | 4/1999 | Mateo de Acosta del Rio et al. | |
| 6,235,883 B1 | 5/2001 | Jakobovits et al. | |
| 6,254,573 B1 | 7/2001 | Haim et al. | |
| 6,309,370 B1 | 10/2001 | Haim et al. | |
| 6,406,632 B1 | 6/2002 | Safir et al. | |
| 6,506,883 B2 | 1/2003 | Meteo de Acosta del Rio et al. | |
| 6,572,585 B2 | 6/2003 | Choi et al. | |
| 6,899,879 B2 | 5/2005 | de Boer et al. | |
| 7,247,301 B2 | 7/2007 | van de Winkel et al. | |
| 7,294,513 B2 | 11/2007 | Wyatt et al. | |
| 7,442,778 B2 | 10/2008 | Gegg et al. | |
| 7,452,967 B2 | 11/2008 | Bertin | |
| 7,485,302 B2 | 2/2009 | Adams et al. | |
| 7,528,242 B2 | 5/2009 | Anderson et al. | |
| 7,560,111 B2 | 7/2009 | Kao et al. | |
| 7,575,923 B2 | 8/2009 | Dorken et al. | |
| 7,595,378 B2 | 9/2009 | Van et al. | |
| 7,635,472 B2 | 12/2009 | Kufer et al. | |
| 7,709,605 B2 | 5/2010 | Knopf et al. | |
| 7,846,445 B2 | 12/2010 | Schellenberger et al. | |
| 7,855,279 B2 | 12/2010 | Schellenberger et al. | |
| 7,879,325 B2 | 2/2011 | Kao et al. | |
| 8,007,796 B2 | 8/2011 | Baeuerle et al. | |
| 8,076,459 B2 | 12/2011 | Hofmeister et al. | |
| 8,129,348 B2 | 3/2012 | Besman et al. | |
| 8,178,495 B2 | 5/2012 | Chilkoti | |
| 8,227,580 B2 | 7/2012 | Jakobovits et al. | |
| 8,236,308 B2 | 8/2012 | Kischel et al. | |
| 8,241,630 B2 | 8/2012 | Kao et al. | |
| 8,492,530 B2 | 7/2013 | Schellenberger et al. | |
| 8,513,390 B2 | 8/2013 | Stagliano et al. | |
| 8,518,404 B2 | 8/2013 | Daugherty et al. | |
| 8,529,898 B2 | 9/2013 | Daugherty et al. | |
| 8,541,203 B2 | 9/2013 | Daugherty et al. | |
| 8,563,269 B2 | 10/2013 | Stagliano et al. | |
| 8,586,041 B2 | 11/2013 | Van et al. | |
| 8,673,860 B2 | 3/2014 | Schellenberger et al. | |
| 8,680,050 B2 | 3/2014 | Schellenberger et al. | |
| 8,703,717 B2 | 4/2014 | Schellenberger et al. | |
| 8,716,448 B2 | 5/2014 | Schellenberger et al. | |
| 8,790,645 B2 | 7/2014 | Kufer et al. | |
| 8,933,197 B2 | 1/2015 | Stemmer et al. | |
| 8,957,021 B2 | 2/2015 | Schellenberger et al. | |
| 9,062,299 B2 | 6/2015 | Schellenberger et al. | |
| 9,102,736 B2 | 8/2015 | Hofmeister et al. | |
| 9,168,312 B2 | 10/2015 | Schellenberger et al. | |
| 9,249,211 B2 | 2/2016 | Schellenberger et al. | |
| 9,371,369 B2 | 6/2016 | Schellenberger et al. | |
| 9,376,672 B2 | 6/2016 | Schellenberger et al. | |
| 9,453,078 B2 | 9/2016 | Stagliano et al. | |
| 9,493,563 B2 | 11/2016 | Blein et al. | |
| 9,540,430 B2 | 1/2017 | Schellenberger et al. | |
| 9,545,442 B2 | 1/2017 | Lowman et al. | |
| 9,562,073 B2 | 2/2017 | Moore et al. | |
| 9,758,776 B2 | 9/2017 | Schellenberger et al. | |
| 9,822,180 B2 | 11/2017 | Cobbold et al. | |
| 9,849,188 B2 | 12/2017 | Schellenberger et al. | |
| 9,850,310 B2 | 12/2017 | Gaudet et al. | |
| 9,926,351 B2 | 3/2018 | Schellenberger et al. | |
| 9,938,331 B2 | 4/2018 | Schellenberger et al. | |
| 9,976,166 B2 | 5/2018 | Schellenberger et al. | |
| 10,000,543 B2 | 6/2018 | Schellenberger et al. | |
| 10,064,957 B2 | 9/2018 | Govindan et al. | |
| 10,106,621 B2 | 10/2018 | Cobbold et al. | |
| 10,172,953 B2 | 1/2019 | Schellenberger et al. | |
| 10,179,819 B2 | 1/2019 | Kirshner et al. | |
| 10,265,414 B2 | 4/2019 | Govindan et al. | |
| 10,590,206 B2 | 3/2020 | Labrijn et al. | |
| 10,633,453 B2 | 4/2020 | Cheng et al. | |
| 10,781,264 B2 | 9/2020 | Raum et al. | |
| 10,844,122 B2 | 11/2020 | Anderson et al. | |
| 10,844,134 B2 | 11/2020 | Baeuerle et al. | |
| 10,961,287 B2 | 3/2021 | Schellenberger et al. | |
| 11,013,800 B2 | 5/2021 | Zhou | |
| 11,155,633 B2 | 10/2021 | Kirshner et al. | |
| 11,161,906 B2 | 11/2021 | Lowman et al. | |
| 11,168,139 B2 | 11/2021 | Igawa et al. | |
| 2003/0049689 A1 | 3/2003 | Edwards et al. | |
| 2003/0181381 A1 | 9/2003 | Himmelspach et al. | |
| 2003/0190740 A1 | 10/2003 | Altman | |
| 2003/0228309 A1 | 12/2003 | Salcedo et al. | |
| 2004/0043446 A1 | 3/2004 | Defrees et al. | |
| 2004/0234609 A1 | 11/2004 | Collier et al. | |
| 2004/0259780 A1 | 12/2004 | Glasebrook et al. | |
| 2005/0042721 A1 | 2/2005 | Fang et al. | |
| 2005/0118136 A1 | 6/2005 | Leung et al. | |
| 2005/0123997 A1 | 6/2005 | Lollar | |
| 2005/0287153 A1 | 12/2005 | Dennis | |
| 2006/0026719 A1 | 2/2006 | Kieliszewski et al. | |
| 2006/0275292 A1 | 12/2006 | Delovitch | |
| 2006/0287220 A1 | 12/2006 | Li et al. | |
| 2006/0293232 A1 | 12/2006 | Levy et al. | |
| 2007/0048282 A1 | 3/2007 | Rosen et al. | |
| 2007/0161087 A1 | 7/2007 | Glaesner et al. | |
| 2007/0203058 A1 | 8/2007 | Lau et al. | |
| 2007/0244301 A1 | 10/2007 | Siekmann et al. | |
| 2008/0039341 A1 | 2/2008 | Schellenberger et al. | |
| 2008/0167238 A1 | 7/2008 | Rosen et al. | |
| 2008/0176288 A1 | 7/2008 | Leung et al. | |
| 2008/0286808 A1 | 11/2008 | Schellenberger et al. | |
| 2008/0312157 A1 | 12/2008 | Levy et al. | |
| 2009/0060862 A1 | 3/2009 | Chang et al. | |
| 2009/0092582 A1 | 4/2009 | Bogin et al. | |
| 2009/0155257 A1 | 6/2009 | Adams et al. | |
| 2010/0150918 A1 | 6/2010 | Kufer et al. | |
| 2010/0189682 A1 | 7/2010 | Schellenberger et al. | |
| 2010/0239554 A1 | 9/2010 | Schellenberger et al. | |
| 2010/0292130 A1 | 11/2010 | Skerra et al. | |
| 2010/0323956 A1 | 12/2010 | Schellenberger et al. | |
| 2011/0046060 A1 | 2/2011 | Schellenberger et al. | |
| 2011/0046061 A1 | 2/2011 | Schellenberger et al. | |
| 2011/0077199 A1 | 3/2011 | Schellenberger et al. | |
| 2011/0151433 A1 | 6/2011 | Schellenberger et al. | |
| 2011/0172146 A1 | 7/2011 | Schellenberger et al. | |
| 2011/0275787 A1 | 11/2011 | Kufer et al. | |
| 2011/0293619 A1 | 12/2011 | Kufer et al. | |
| 2012/0034228 A1 | 2/2012 | Kufer et al. | |
| 2013/0052160 A1 | 3/2013 | Zitvogel et al. | |
| 2013/0129729 A1 | 5/2013 | Kischel et al. | |
| 2013/0165389 A1 | 6/2013 | Schellenberger et al. | |
| 2014/0303084 A1* | 10/2014 | Thorn | C07K 14/745 514/13.7 |
| 2015/0037334 A1* | 2/2015 | Kufer | A61P 43/00 424/134.1 |
| 2015/0183875 A1* | 7/2015 | Cobbold | A61P 31/00 424/135.1 |
| 2016/0122425 A1 | 5/2016 | Daugherty et al. | |
| 2016/0152707 A1 | 6/2016 | Kufer et al. | |
| 2016/0193332 A1 | 7/2016 | Lowman et al. | |
| 2016/0194339 A1 | 7/2016 | Chung et al. | |
| 2016/0228546 A1 | 8/2016 | Stagliano et al. | |
| 2016/0289324 A1 | 10/2016 | Moore et al. | |
| 2017/0002082 A1 | 1/2017 | West et al. | |
| 2017/0081397 A1 | 3/2017 | Stagliano et al. | |
| 2017/0096489 A1 | 4/2017 | Lowman et al. | |
| 2017/0247476 A1 | 8/2017 | Yan et al. | |
| 2018/0037651 A1 | 2/2018 | Attar et al. | |
| 2018/0057593 A1 | 3/2018 | Dennis | |
| 2018/0244736 A1 | 8/2018 | Schellenberger et al. | |
| 2019/0382456 A1 | 12/2019 | Apgar et al. | |
| 2020/0048349 A1 | 2/2020 | Gaudet et al. | |
| 2020/0199231 A1 | 6/2020 | Engelberts et al. | |
| 2020/0277397 A1 | 9/2020 | Satijn et al. | |
| 2021/0047406 A1 | 2/2021 | Irving et al. | |

FOREIGN PATENT DOCUMENTS

| | | |
|---|---|---|
| EP | 0942968 A2 | 9/1999 |
| EP | 1940881 A2 | 7/2008 |
| EP | 1629011 B1 | 1/2010 |
| EP | 2155783 A2 | 2/2010 |

(56) References Cited

FOREIGN PATENT DOCUMENTS

| EP | 2352765 A2 | 8/2011 | | |
|---|---|---|---|---|
| EP | 2155788 B1 | 6/2012 | | |
| EP | 2369005 B1 | 4/2013 | | |
| EP | 1400534 B1 | 10/2015 | | |
| EP | 2352763 B1 | 4/2016 | | |
| EP | 1940881 B1 | 11/2016 | | |
| EP | 2292664 B1 | 11/2016 | | |
| EP | 2542590 B1 | 5/2017 | | |
| EP | 3024851 B1 | 5/2018 | | |
| EP | 2904016 B1 | 11/2018 | | |
| EP | 2552964 B1 | 10/2019 | | |
| EP | 3049440 B1 | 3/2020 | | |
| EP | 3177646 B1 | 10/2020 | | |
| EP | 2819701 B2 | 6/2021 | | |
| EP | 3406633 B1 | 3/2022 | | |
| EP | 3387013 B1 | 6/2022 | | |
| WO | WO-9306844 A1 | 4/1993 | | |
| WO | WO 1996/040210 A1 | 12/1996 | | |
| WO | WO-9733552 A1 | 9/1997 | | |
| WO | WO-9949901 A1 | 10/1999 | | |
| WO | WO-02077036 A2 | 10/2002 | | |
| WO | WO-2004106381 A1 | 12/2004 | | |
| WO | WO-2005025499 A2 | 3/2005 | | |
| WO | WO-2005025499 A3 | 5/2005 | | |
| WO | WO 2005/118635 A2 | 12/2005 | | |
| WO | WO-2006081249 A2 | 8/2006 | | |
| WO | WO-2006081249 A3 | 2/2007 | | |
| WO | WO 2007/033230 A2 | 3/2007 | | |
| WO | WO-2007042261 A2 * | 4/2007 | ........... | C07K 16/468 |
| WO | WO-2007073486 A2 | 6/2007 | | |
| WO | WO-2007103455 A2 | 9/2007 | | |
| WO | WO-2007103515 A2 | 9/2007 | | |
| WO | WO-2007103455 A3 | 11/2007 | | |
| WO | WO-2008049931 A1 | 5/2008 | | |
| WO | WO-2008155134 A1 | 12/2008 | | |
| WO | WO-2009023270 A2 | 2/2009 | | |
| WO | WO-2010091122 A1 | 8/2010 | | |
| WO | WO-2010144502 A2 | 12/2010 | | |
| WO | WO-2010144508 A1 | 12/2010 | | |
| WO | 2011/033105 A1 | 3/2011 | | |
| WO | WO-2011028228 A1 | 3/2011 | | |
| WO | WO-2011028229 A1 | 3/2011 | | |
| WO | WO-2011028344 A2 | 3/2011 | | |
| WO | WO-2011033105 A1 | 3/2011 | | |
| WO | WO-2011084808 A2 | 7/2011 | | |
| WO | 2011123813 A2 | 10/2011 | | |
| WO | WO 2011/131472 A1 | 10/2011 | | |
| WO | WO-2011123813 A2 | 10/2011 | | |
| WO | WO-2011123830 A2 | 10/2011 | | |
| WO | WO-2013040093 A2 | 3/2013 | | |
| WO | WO-2013122617 A1 | 8/2013 | | |
| WO | WO-2013130683 A2 | 9/2013 | | |
| WO | WO-2013130684 A1 | 9/2013 | | |
| WO | WO-2013184216 A1 | 12/2013 | | |
| WO | 2014/011819 A2 | 1/2014 | | |
| WO | WO-2014011819 A2 | 1/2014 | | |
| WO | WO-2014164568 A1 | 10/2014 | | |
| WO | 2014194282 A2 | 12/2014 | | |
| WO | WO-2014194282 A2 | 12/2014 | | |
| WO | 2015/023891 A2 | 2/2015 | | |
| WO | WO-2015023891 A2 | 2/2015 | | |
| WO | WO 2016/081884 A2 | 5/2016 | | |
| WO | WO-2016077505 A2 | 5/2016 | | |
| WO | WO-2016109823 A1 | 7/2016 | | |
| WO | WO-2017040344 A2 | 3/2017 | | |
| WO | 2017/134134 A1 | 8/2017 | | |

OTHER PUBLICATIONS

Winkler et al. (J. Imm., 265:4505-4514, 2000).*
Choi et al (MB 7:3327-3334, 2011).*
Lloyd et al (Protein Engineering, Design & Selection, 22:159-168, 2009).*
Edwards et al (J Mol Biol, 14;334(1):103-118, 2003).*
Goel et al (JI, 173(12):7358-7367, 2004).*
Anonymous. XTEN Trademark of Amunix Operating Inc.—Registration No. 4871664—Serial No. 86395983 :: Justia Trademarks, Dec. 15, 2015.
European search report with written opinion dated Apr. 1, 2019 for EP Application No. 16842718.
Sebastian, et al. Treatment of malignant pleural effusion with the trifunctional antibody catumaxomab (Removab) (anti-EpCAM x Anti-CD3): results of a phase 1/2 study. J Immunother. Feb.-Mar. 2009;32(2):195-202. doi: 10.1097/CJI.0b013e318195b5bb.
Sim, et al. Abstract 3638: AMX-168, a long-acting, tumor protease-sensitive bispecific precursor for the treatment of solid malignancies. Cancer Res Jul. 1, 2017 (77) (13 Supplement) 3638; DOI: 10.1158/1538-7445.AM2017-3638.
Zhang, et al. An EpCAM/CD3 bispecific antibody efficiently eliminates hepatocellular carcinoma cells with limited galectin-1 expression. Cancer Immunol Immunother. Feb. 2014;63(2):121-32. doi: 10.1007/s00262-013-1497-4. Epub Nov. 1, 2013.
Altschul, et al. Basic local alignment search tool. Journal of Molecular Biology 215.3 (1990): 403-410.
Alvarez, et al. Improving Protein Pharmacokinetics by Genetic Fusion to Simple Amino Acid Sequences. J Biol Chem. 2004; 279: 3375-81.
Arndt, et al. Factors influencing the dimer to monomer transition of an antibody single-chain Fv fragment. Biochemistry. 1998; 37(37):12918-26.
Ausubel, et al. eds. Current Protocols in Molecular Biology. Wiley. 1987.
Bailon, et al. Rational design of a potent, long-lasting form of interferon: a 40 kDa branched polyethylene glycol-conjugated interferon alpha-2a for the treatment of hepatitis C. Bioconjug Chem. Mar.-Apr. 2001;12(2):195-202.
Buscaglia, et al. Tandem amino acid repeats from Trypanosoma cruzi shed antigens increase the half-life of proteins in blood. Blood. Mar. 15, 1999;93(6):2025-32.
Chou, et al. Conformational parameters for amino acids in helical, β-sheet, and random coil regions calculated from proteins. Biochemistry 13.2 (1974): 211-222.
Chou, et al. Empirical predictions of protein conformation. Annual review of biochemistry 47.1 (1978): 251-276.
Chou, et al. Prediction of Protein Conformation. Biochemistry. 1974; 13: 222-245.
Chou, et al. Prediction of the secondary structure of proteins from their amino acid sequence. Adv Enzymol Relat Areas Mol Biol. 1978;47:45-148.
Chou; et al., Prediction of the Secondary Structure of Proteins from Their Amino Acid Sequence, from Advances in Enzymology vol. 47, John Wiley and Sons. Published 1978, p. 60.
Chou-Fasman values for random 200mer sequences composed of the amino acids GADSTEP; Reply to notice of opposition dated Apr. 8, 2016 for EP2402754.
Cleland, et al. A Monthly Dosed GLP-1 Analog for Treatment of Type 2 Diabetes Mellitus. Diabetes, 2010; 59(1):A104. 70th Annual Meeting of the American Diabetes Association, Orland, FL, USA 2010.
Cleland, et al. A novel long-acting human growth hormone fusion protein (VRS-317): enhanced in vivo potency and half-life. J Pharm Sci. Aug. 2012;101(8):2744-54. doi: 10.1002/jps.23229. Epub Jun. 7, 2012.
Cleland, et al. An extended half-life exenatide construct for weekly administration in the treatment of diabetes mellitus. In Diabetes, vol. 58, pp. A511-A512. 1701 N Beauregard St, Alexandria, VA 22311-1717 USA: Amer Diabetes Assoc, 2009. Abstract only.
Collen, et al. Polyethylene Glycol-Derivatized Cysteine-Substitution Variants of Recombinant Staphylokinase for Single-Bolus Treatment of Acute Myocardial Infarction. Circulation. 2000; 102: 1766-72.
Composition and properties of some URPs according to the invention; Reply to notice of opposition dated Apr. 8, 2016 for EP2402754.
Co-pending U.S. Appl. No. 15/887,313, filed Feb. 2, 2018.
Corrected version of "Exhibit 1" (D23) without cut and paste error; Reply to notice of opposition dated Apr. 8, 2016 for EP2402754.

(56) References Cited

OTHER PUBLICATIONS

D'Aquino, et al. The magnitude of the backbone conformational entropy change in protein folding. Proteins. 1996; 25: 143-56.

Deckert, et al. Pharmacokinetics and microdistribution of polyethylene glycol-modified humanized A33 antibody targeting colon cancer xenografts. Int J Cancer. 2000; 87: 382-90.

Dhalluin, et al. Structural and biophysical characterization of the 40 kDa PEG-interferon-alpha2a and its individual positional isomers. Bioconjug Chem. 2005; 16: 504-17.

Ding et al., "Multivalent Antiviral XTEN-Peptide Conjugates with Long in Vivo Half-Life and Enhanced Solubility," Bioconjugate Chemistry, vol. 25, No. 7, pp. 1351-1359, epub Jun. 23, 2014.

Ellis, et al. Valid and invalid implementations of GOR secondary structure predictions. Comput Appl Biosci. Jun. 1994;10(3):341-8.

Geething, et al. Gcg-XTEN: an improved glucagon capable of preventing hypoglycemia without increasing baseline blood glucose. PLoS One. Apr. 14, 2010;5(4):e10175. doi: 10.1371/journal.pone.0010175.

Gustafsson et al. Codon bias and heterologous protein expression. Trends in Biotechnology, 22.7 (Jul. 2004): 346-353.

Hopp, et al. Prediction of protein antigenic determinants from amino acid sequences. Proc Natl Acad Sci U S A 1981; 78, 3824-3828, #3232.

International search report and written opinion dated Dec. 20, 2010 for PCT Application No. US10/02147.

International search report dated Jul. 12, 2011 for PCT Application No. US10/61590.

International search report dated Dec. 26, 2007 for PCT Application No. US2007/05952.

International search report dated Mar. 16, 2009 for PCT Application No. US2008/09787.

International search report dated Apr. 20, 2010 for PCT Application No. US10/23106.

International search report with written opinion dated Feb. 27, 2017 for PCT/US2016/049137.

Kangueane, et al., T-Epitope Designer: A HLA-peptide binding prediction server. May 15, 2005, 1(1), 21-4.

Kochendoerfer. Chemical and biological properties of polymer-modified proteins. Expert Opin Biol Ther. 2003; 3: 1253-61.

Kohn, et al. Random-coil behavior and the dimensions of chemically unfolded proteins. Proc Natl Acad Sci U S A. Aug. 24, 2004; 101 (34):12491-6.

Kornblatt, et al. Cross-linking of cytochrome oxidase subunits with difluorodinitrobenzene. Can J. Biochem. 1980; 58: 219-224.

Kubetzko, et al. Protein PEGylation decreases observed target association rates via a dual blocking mechanism. Mol Pharmacol. 2005; 68: 1439-54.

Kyngas, et al. Unreliability of the Chou-Fasman parameters in predicting protein secondary structure. Protein Eng. May 1998;11(5):345-8.

Levitt, M. A simplified representation of protein conformations for rapid simulation of protein folding. J Mol Biol. Jun. 14, 1976;104(1):59-107.

McPherson, et al. eds. PCR 2: a practical approach. Oxford University Press. 1995.

Mitraki, et al. Protein Folding Intermediates and Inclusion Body Formation. Bio/Technology. 1989;7:690-697.

Oslo, ed. Remington's Pharmaceutical Sciences. 16th edition. 1980.

Pepinsky, et al. Improved pharmacokinetic properties of a polyethylene glycol-modified form of interferon-beta-1a with preserved in vitro bioactivity. J Pharmacol Exp Ther. 2001; 297: 1059-66.

Podust, et al., Extension of in vivo half-life of biologically active peptides via chemical conjugation to XTEN protein polymer. Protein Engineering Design and Selection, vol. 26, No. 11, Oct. 16, 2013, pp. 743-753.

Sambrook, et al. Molecular Cloning: A Laboratory Manual, 2nd Edition; Current Protocols In Molecular Biology. 1989.

Schellenberger, et al., A recombinant polypeptide extends the in vivo half-life of peptides and proteins in a tunable manner. Nature Biotechnology, Nature Publishing Group, US, vol. 27, No. 2, Nov. 15, 2009, pp. 1186-1190.

Schellenberger et al. "Online Supplementary material: A recombinant polypeptide extends the in vivo half-life of peptides and proteins in a tunable manner", Nature Biotechnology, vol. 27, No. 12, Nov. 15, 2009 (Nov. 15, 2009), pp. 1186-1190, XP055190665, ISSN: 1087-0156, DOI: 10.1038/nb.1588.

Schlapschy, et al. Fusion of a recombinant antibody fragment with a homo-amino-acid polymer: effects on biophysical properties and prolonged plasma half-life. Protein Eng Des Sel. Jun. 2007;20(6):273-84. Epub Jun. 26, 2007.

Singh, et al. ProPred: Prediction of HLA-DR binding sites. Bioinformatics. 17 (2001): 1236-1237.

Smith, et al. Single-step purification of polypeptides expressed in *Escherichia coli* as fusions with glutathione S-transferase. Gene. 1988; 67(1):31-40.

Stickler, et al. Human population-based identification of CD4(+) T-cell peptide epitope determinants. J Immunol Methods. 2003; 281: 95-108.

Stites, et al. Empirical evaluation of the influence of side chains on the conformational entropy of the polypeptide backbone. Proteins. 1995; 22: 132-140.

Sturniolo, et al. Generation of tissue-specific and promiscuous HLA ligand databases using DNA microarrays and virtual HLA class II matrices. Natural Biotechnol. 1999; 17: 555-561.

TEPITOPE values for random 200mer sequences composed of the amino acids GADSTEP; Reply to notice of opposition dated Apr. 8, 2016 for EP2402754.

Uversky, et al. Why are "natively unfolded" proteins unstructured under physiologic conditions? Proteins. Nov. 15, 2000;41(3):415-27.

Venkatachalam, et al. Conformation of polypeptide chains. Annu Rev Biochem. 1969; 38: 45-82.

Voet, et al., Biochemistry (3rd Ed.). John Wiley and Sons. Published 2004, p. 230.

Walker, et al. Using protein-based motifs to stabilize peptides. J Pept Res. Nov. 2003;62(5):214-26.

Wright, et al. Intrinsically unstructured proteins: re-assessing the protein structure-function paradigm. J Mol Biol. Oct. 22, 1999;293(2):321-31.

Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.

Adams, et al. High affinity restricts the localization and tumor penetration of single-chain fv antibody molecules. Cancer Res. 61(12):4750-5 (Jun. 15, 2001).

Adams, et al. Increased affinity leads to improved selective tumor delivery of single-chain Fv antibodies. Cancer Res. 58(3):485-90 (Feb. 1, 1998).

Adams. The development of proteasome inhibitors as anticancer drugs. Cancer Cell 5:417-421 (May 2004).

Akagi et al. CA19-9 epitope a possible marker for MUC-1/Y protein. International Journal of Oncology 18:1085-1091 (2001).

Albright et al. Matrix metalloproteinase-activated doxorubicin prodrugs inhibit HT1080 xenograft growth better than doxorubicin with less toxicity. Mol Cancer Ther 4(5):751-760 (May 2005).

Amann et al. Therapeutic window of an EpCAM/CD3-speciWc BiTE antibody in mice is determined by a subpopulation of EpCAM-expressing lymphocytes that is absent in humans. Cancer Immunol Immunother (2009) 58:95-109. Published online Jul. 2, 2008.

Amler et al. HER2 as a Therapeutic Target in Ovarian Cancer. Ovarian Cancer—Clinical and Therapeutic Perspectives (Feb. 15, 2012). 25 pages. DOI: 10.5772/29064. Available at URL: https://www.intechopen.com/books/ovarian-cancer-clinical-and-therapeutic-perspectives/her2-as-a-ther . . . .

Annex 2: Chou Fasman (1974) and Tepitope analyses of prior art sequences. Opposition dated Aug. 18, 2015 by XL-Protein GmbH against EP2402754 Application No. 11172812.7.

(56) References Cited

OTHER PUBLICATIONS

Arcidiacono et al. Expression of matrix metalloproteinase-11 is increased under conditions of insulin resistance. World J Diabetes 8(9):422-428 (Sep. 15, 2017). DOI: 10.4239/wjd.v8.i9.422.

Armstrong. EpCAM: A New Therapeutic Target for an Old Cancer Antigen. Cancer Biology & Therapy 2(4):320-325 (Jul./Aug. 2003).

Asano et al. Highly Effective Recombinant Format of a Humanized IgG-like Bispecific Antibody for Cancer Immunotherapy with Retargeting of Lymphocytes to Tumor Cells. The Journal of Biological Chemistry 282(38):27659-27665 (Sep. 21, 2007).

Au et al. Clinical aspects of drug delivery to tumors. Journal of Controlled Release 78:81-95 (2002).

Ayers et al. IFN-γ-related mRNA profile predicts clinical responseto PD-1 blockade. The Journal of Clinical Investigation 127(8):2930-2940 (Aug. 2017).

Bagshawe et al. Antibody directed enzyme prodrug therapy: a pilot-scale clinical trial. Tumor Targeting 1:17-29 (1995).

Bagshawe et al. Antibody Directed Enzyme Prodrug Therapy (ADEPT): Clinical Report. Disease Markers 9:233-238 (1991).

Bagshawe et al. Antibody-directed enzyme prodrug therapy (ADEPT) for cancer. Expert Opin Biol Ther 4(11):1777-1789 (2004).

Baldus et al. Coexpression of MUC1 Mucin Peptide Core and the Thomsen-Friedenreich Antigen in Colorectal Neoplasms. Cancer 82(6):1019-1027 (Mar. 15, 1998).

Balzar et al. The Structural Analysis of Adhesions Mediated by Ep-CAM. Experimental Cell Research 246:108-121 (1999).

Banerjee et al. Poly(ethylene glycol)-Prodrug Conjugates: Concept, Design, and Applications. vol. 2012, Article ID 103973 (2012). 17 pages. doi:10.1155/2012/103973.

Bargou et al. Tumor Regression in Cancer Patients by Very Low Doses of a T Cell Engaging Antibody. Science 321:974-977 (Aug. 15, 2008). DOI: 10.1126/science.1158545.

Barok et al. Trastuzumab-DM1 is highly effective in preclinical models of HER2-positive gastric cancer. Cancer Letters 306:171-179 (2011).

Baxter et al. Pharmacokinetic analysis of the microscopic distribution of enzyme-conjugated antibodies and prodrugs: comparison with experimental data. British Journal of Cancer 73:447-456 (1996).

Belimezi et al. Growth inhibition of breast cancer cell lines overexpressing Her2/neu by a novel internalized fully human Fab antibody fragment. Cancer Immunol Immunother 55:1091-1099 (2006). Published online Nov. 26, 2005.

Bell, et al. "Differential tumor-targeting abilities of three single-domain antibody formats." Cancer Letters 289:81-90 (Mar. 1, 2010). Epub Aug. 28, 2009. doi: 10.1016/j.canlet.2009.08.003.

Bellone et al. Solitomab, an EpCAM/CD3 bispecific antibody construct(BiTE), is highly active against primary uterine serouspapillary carcinoma cell lines in vitro. American Journal of Obstetrics & Gynecology pp. 99.e2-99.e8 (Jan. 2016).

Berek et al. Catumaxomab for the Treatment of Malignant Ascites in Patients With Chemotherapy-Refractory Ovarian Cancer. Int J Gynecol Cancer 24(9):1583-1589 (Nov. 2014).

Biggers et al. VB4-845, a conjugated recombinant antibody and immunotoxin for head and neck cancer and bladder cancer. Current Opinion in Molecular Therapeutics 10(2):176-186 (2008).

Birkedal-Hansen et al. Matrix Metalloproteinases: A Review. Critical Reviews in Oral Biology & Medicine 4(2):197-250 (1993).

BLINCYTO Package Insert. AMGEN. Issued Dec. 2014.

Borsi et al. Selective targeting of tumoral vasculature: Comparison of different formats of an antibody (L19) to the ED-B domain of fibronectin. Int J Cancer 102:75-85 (2002).

Boustany et al. EGFR-CD3 Bispecific Probody™ Therapeutic Induces Tumor Regressions and Increases Maximum Tolerated Dose 60 fold in Preclinical Studies. Poster. CytomX Therapeutics. Copyright 2017.

Boyd et al. PoPS: A Computational Tool for Modeling and Predicting Protease Specificity. Journal of Bioinformatics and Computational Biology 3(3):551-585 (2005).

Brand et al. Treatment of Colorectal Liver Metastases by Adenoviral Transfer of TissueInhibitor of Metalloproteinases-2 into the Liver Tissue. Cancer Research 60:5723-5730 (Oct. 15, 2000).

Bremer et al. In vivo molecular target assessment of matrix metalloproteinase inhibition. Nature Medicine 7(6):743-748 (Jun. 2001).

Brischwein et al. MT110: A novel bispecific single-chain antibody construct with highefficacy in eradicating established tumors. Molecular Immunology 43:1129-1143 (2006). Available online Sep. 1, 2005.

Buache et al. Functional relationship between matrixmetalloproteinase-11 and matrix metalloproteinase-14. Cancer Medicine 3(5):1197-1210 (2014). doi: 10.1002/cam4.290.

Burges et al. Effective Relief of Malignant Ascites in Patients with Advanced Ovarian Cancer by a Trifunctional Anti-EpCAM Anti-CD3 Antibody: A Phase I/II Study. Clin Cancer Res 13(13):3899-3905 (Jul. 1, 2017).

Byrne et al. A tale of two specificities: bispecific antibodies for therapeutic and diagnostic applications. Trends in Biotechnology 31(11):621-632 (Nov. 2013).

Cai, et al. Developments in human growth hormone preparations: sustained-release, prolonged half-life, novel injection devices, and alternative delivery routes. Int J Nanomedicine. 2014; 9: 3527-3538. Published online Jul. 25, 2014. doi: 10.2147/IJN.S63507.

Cal and Obaya, eds. Proteases and Cancer: Methods and Protocols. Humana Press. Copyright 2018. DOI: https://doi.org/10.1007/978-1-4939-7595-2.

Cao et al. Multiformat T-Cell-Engaging Bispecific Antibodies Targeting Human Breast Cancers. Angew Chem Int Ed 54:7022-7027 (2015). DOI: 10.1002/anie.201500799.

Cell Therapeutics Press Release. Cell Therapeutics Inc.'s Polyglutamate (PG) Technology Highlighted at International Polymer Therapeutics Meeting; Novel Recombinant Technology Extends PG Platform to G-CSF. Jan. 4, 2002. PR Newswire. Opposition by XL-Protein GmbH against EP2402754 Application No. 11172812.7.

Cesano et al. CD22 as a Target of Passive Immunotherapy. Seminars in Oncology 30(2):253-257 (Apr. 2003).

Cheadle. MT-103 Micromet/MedImmune. Current Opinion in Molecular Therapeutics 8(1):62-68 (2006).

Chen et al. A Unique Substrate Recognition Profile for MatrixMetalloproteinase-2. The Journal of Biological Chemistry 277(6):4485-4491 (Feb. 8, 2002). Published, JBC Papers in Press, Nov. 2, 2001, DOI 10.1074/jbc.M109469200.

Cheng et al. Successful engineering of a highly potent single-chain variable-fragment (scFv) bispecific antibody to target disialoganglioside (GD2) positive tumors. Oncoimmunology 5(6):e1168557 (2016). 9 pages.

Chhieng et al. Expression of CEA, Tag-72, and Lewis-Y Antigen in Primary and Metastatic Lesions of Ovarian Carcinoma, pp. 1016-1021. Presented in part at the 93rd annual meeting of American Association of Cancer Research, San Francisco, CA, Apr. 6-10, 2002,and the 10th annual Specialized Program of Research Excellence (SPORE) meeting, Chantilly, VA, Jul. 13-16, 2002.

Choi et al. Bispecific antibodies engage T cells for antitumor immunotherapy. Expert Opin. Biol. Ther. [Early Online], Copyright 2011 Informa UK, Ltd. DOI: 10.1517/14712598.2011.572874. 11 pages.

Clapper et al. Detection of Colorectal Adenomas Using a Bioactivatable Probe Specific for Matrix Metalloproteinase Activity. Neoplasia 13(8):685-691 (Aug. 2011).

Cramer et al. Conditions Associated with Antibodies Against the Tumor-Associated Antigen MUC1 and Their Relationship to Risk for Ovarian Cancer. Cancer Epidemiology, Biomarkers & Prevention 14(5):1125-1131 (May 2005).

Cretney et al. Cancer: Novel therapeutic strategies that exploit the TNF-related apoptosisinducing ligand (TRAIL)/TRAIL receptor pathway. The International Journal of Biochemistry & Cell Biology 39280-286 (2007). Available online Oct. 7, 2006.

Croce et al. Expression of Tumour Associated Antigens in Normal, Benign and Malignant Human Mammary Epithelial Tissue: A Comparative Immunohistochemical Study. Anticancer Research 17:4287-7292 (1997).

(56) References Cited

OTHER PUBLICATIONS

Dahlberg et al. The Lymphatic System Plays a Major Role in the Intravenous and Subcutaneous Pharmacokinetics of Trastuzumab in Rats. Mol Pharmaceutics 11:496-504 (Dec. 18, 2013). DOI: dx.doi.org/10.1021/mp400464s.

Danhier et al. To exploit the tumor microenvironment: Passive and active tumor targeting of nanocarriers for anti-cancer drug delivery. Journal of Controlled Release 148:135-146 (2010). Available online Aug. 24, 2010.

Davol et al. Anti-CD3 x Anti-HER2 Bispecific Antibody Effectively Redirects Armed T Cells to Inhibit Tumor Development and Growth in Hormone-Refractory Prostate Cancer-Bearing Severe Combined Immunodeficient Beige Mice. Clinical Prostate Cancer 3(2):112-121 (Sep. 2004).

De Goeij et al. HER2 monoclonal antibodies that do not interfere with receptor heterodimerization-mediated signaling induce effective internalization and represent valuable components for rational antibody-drug conjugate design. mAbs 6(2):392-402 (Mar./Apr. 2014). Published online Jan. 3, 2014. DOI: 10.4161/mabs.27705.

De Lorenzo et al. Biological properties of a human compact anti-ErbB2 antibody. Carcinogenesis 26(11):1890-1895 (2005). Advance access publication Jun. 1, 2005. doi:10.1093/carcin/bgi146.

De Lorenzo et al. Intracellular route and mechanism of action of ERB-hRNase, a human anti-ErbB2 anticancer immunoagent. FEBS Letters 581:296-300 (2007). Available online Jan. 2, 2007.

De Vega et al. Multimodal laser ablation/desorption imaging analysis of Znand MMP-11 in breast tissues. Anal Bioanal Chem 410:913-922 (2018). Published online Aug. 12, 2017. DOI 10.1007/S00216-017-0537-x.

Decision revoking the European Patent dated Mar. 16, 2016 for EP1996220 Application No. 07752636.6.

Decision revoking the European Patent dated May 9, 2017 for EP2402754 Application No. 11172812.7.

Denton et al. Primary Sequence Determination and Molecular Modelling of the Variable Region of an AntiMUC1 Mucin Monoclonal Antibody. European Journal of Cancer 31A(2):214-221 (1995).

Deppisch et al. Efficacy and Tolerability of a GD2-Directed Trifunctional Bispecific Antibody in a Preclinical Model: Subcutaneous Administration Is Superior to Intravenous Delivery. Mol Cancer Ther 14(8):1877-1883 (Aug. 2015).

Desnoyers et al. Supplementary Materials for Tumor-Specific Activation of an EGFR-Targeting Probody Enhances Therapeutic Index. Sci Transl Med 5:207ra144 (Oct. 16, 2013). 14 pages. DOI: 10.1126/scitranslmed.3006682.

Desnoyers et al. Tumor-Specific Activation of an EGFR-Targeting Probody Enhances Therapeutic Index. Science Translational Medicine 5(207):207ra144 (Oct. 16, 2013). 12 pages.

Devy et al. Selective Inhibition of Matrix Metalloproteinase-14 Blocks TumorGrowth, Invasion, and Angiogenesis. Cancer Res 69(4):1517-1526 (Feb. 15, 2009). Published online Feb. 10, 2009. DOI: 10.1158/0008-5472.CAN-08-3255.

Di Paolo et al. A Recombinant Immunotoxin Derived from a Humanized Epithelial Cell Adhesion Molecule-specific Single-Chain Antibody Fragment Has Potent and Selective Antitumor Activity. Clinical Cancer Research 9:2837-2848 (Jul. 2003).

Donaldson, J. M. et al., Design and development of masked therapeutic antibodies to limit off-target effects: application to anti-EGFR antibodies. Cancer Biology & Therapy 8(22):2147-2152 (Nov. 2009).

Dorvillius et al. Targeting of Human Breast Cancer by a Bispecific Antibody Directed against Two Tumour-Associated Antigens: ErbB-2 and Carcinoembryonic Antigen. Tumor Biol 23:337-347 (2002). DOI: 10.1159/000069793.

Duffy et al. uPA and PAI-1 as biomarkers in breast cancer: validated for clinical use in level-of-evidence-1 studies. Breast Cancer Research 16:428 (2014). 10 pages.

Endo-Munoz et al. Progression of Osteosarcoma from a Non-Metastatic to a Metastatic Phenotype Is Causally Associated with Activation of an Autocrine and Paracrine uPA Axis. PLOS ONE (Aug. 28, 2015). 22 pages. DOI:10.1371/journal.pone.0133592.

Feldmann et al. Novel Humanized and Highly Efficient Bispecific Antibodies Mediate Killing of Prostate Stem Cell Antigen-Expressing Tumor Cells by CD8+ and CD4+ T Cells. The Journal of Immunology 189:3249-3259 (2012).

Fernandez-Garcia et al. Expression and prognostic significance of fibronectin and matrix metalloproteases in breast cancer metastasis. Histopathology 64:512-522 (2014). DOI: 10.1111/his.12300.

Filpula. Releasable PEGylation of Mesothelin Targeted Immunotoxin SS1P Achieves Single Dosage Complete Regression of a Human Carcinoma in Mice. Bioconjugate Chem 18:773-784 (2007). Published online Mar. 9, 2007. DOI: 10.1021/bc060314x.

Fortmüller et al. Effective Targeting of Prostate Cancer by Lymphocytes Redirected by a PSMA CD3 Bispecific Single-Chain Diabody. The Prostate 71:588-596 (2011).

Fousek et al. The Evolution of T-cell Therapies for Solid Malignancies. Clin Cancer Res 21 (15)3384-3392 (Aug. 1, 2015).

Friberg et al. Blinatumomab (Blincyto®); lessons learned from the bispecific t-cell engager (BiTE®) in acutelymphocytic leukemia (ALL). © The Author 2017. Published by Oxford University Press on behalf of the European Society for MedicalOncology. 8 pages.

Garber. Bispecific antibodies rise again. Nature Reviews—Drug Discovery, vol. 14, pp. 799-801 (Nov. 2014).

Germain et al. Redirecting NK cells mediated tumor cell lysis by a new recombinant bifunctional protein. Protein Engineering, Design & Selection 21(11):665-672 (2008). Published online Sep. 11, 2008. doi:10.1093/protein/gzn047.

Graves et al. Proinvasive Properties of Ovarian Cancer Ascites-Derived Membrane Vesicles. Cancer Research 64:7045-7049 (Oct. 1, 2004).

Haense et al. A phase I trial of the trifunctional anti Her2 x anti CD3 antibody ertumaxomab in patients with advanced solid tumors. BMC Cancer 16:420 (2016). 10 pages. DOI 10.1186/S12885-016-2449-0.

Herbst. Review of Epidermal Growth Factor Receptor Biology. Int J Radiation Oncology Biol Phys vol. 59, No. 2, Supplement, pp. 21-26 (2004). doi:10.1016/j.ijrobp.2003.11.041.

Hinrichs et al. Reassessing target antigens for adoptive T-cell therapy. Nature Biotechnology 31(11):999-1008 (Nov. 2013).

Hoffmann et al. Serial killing of tumor cells by cytotoxic T cells redirected with a CD19-/CD3-bispecific single-chain antibody construct. Int J Cancer 115:98-104 (2005). Published online Feb. 1, 2005. DOI 10.1002/ijc.20908.

Hsin et al. MMP-11 promoted the oral cancer migration and FAK/Src activation. Oncotarget 8(20):32783-32793 (Mar. 2, 2017).

Iniesta et al. Biological and clinical significance of MMP-2, MMP-9,TIMP-1 and TIMP-2 in non-small cell lung cancer. Oncology Reports 17:217-223 (2007).

Internet printout for Chou Fasman algorithm, 1974. Available at http://www.biogem.org/tool/chou-fasman. Opposition by XL-Protein GmbH against EP2402754 Application No. 11172812.7.

Ishiguro et al. An anti-glypican 3/CD3 bispecific T cell-redirecting antibody for treatment of solid tumors. Sci Transl Med 9:eaa14291 (Oct. 4, 2017). 13 pages. DOI: 10.1126/scitranslmed.aal4291.

Ishiguro et al. Supplementary Materials for An anti-glypican 3/CD3 bispecific T cell-redirecting antibody for treatment of solid tumors. Sci Transl Med 9:eaa14291 (Oct. 4, 2017). 25 pages. DOI: 10.1126/scitranslmed.aal4291.

James et al. Biophysical Mechanism of T Cell Receptor Triggering in a Reconstituted System. Nature 487(7405):64-69 (Jul. 5, 2012).

Jager et al. Immunomonitoring Results of a Phase II/III Study of Malignant Ascites Patients Treated with the Trifunctional Antibody Catumaxomab (Anti-EpCAM Anti-CD3). Cancer Res 72(1):24-32 (Jan. 1, 2012). Published online Nov. 1, 2011. DOI: 10.1158/0008-5472.CAN-11-2235.

Jin et al. MetMAb, the one-armed 5D5 anti-c-met antibody, inhibits orthotopic pancreatic tumor growth and improves survival. Cancer Res 68(11):4360-4368 (Jun. 1, 2008).

Junttila et al. Antitumor Efficacy of a Bispecific Antibody That Targets HER2 and Activates T Cells. Cancer Res 74(19):5561-5571 (2014). doi: 10.1158/0008-5472.CAN-13-3622-T.

Klinger. BiTE® Antibody Constructs Beyond Blinatumomab: Overview of Amgen's Early-Stage BiTE® Pipeline (slides). CHI's 6th Annual Immuno-Oncology Summit (Aug. 27-31, 2018).

(56) References Cited

OTHER PUBLICATIONS

Koblinski, et al. Unraveling the role of proteases in cancer. Clin Chim Acta. Feb. 15, 2000;291(2):113-35.
Kridel et al. Substrate Hydrolysis by Matrix Metalloproteinase-9. J Biol Chem 276(23):20572-20578 (Jun. 8, 2001). Published, JBC Papers in Press, Mar. 14, 2001, DOI 10.1074/jbc.M100900200.
Lafky et al. Clinical implications of the ErbB/epidermal growth factor (EGF) receptor family and its ligands in ovarian cancer. Biochimica et Biophysica Acta 1785:232-265 (2008). Available online Feb. 7, 2008.
Lameris et al. Bispecific antibody platforms for cancer immunotherapy. Critical Reviews in Oncology/Hematology 92:153-165 (2014).
Leong et al. An anti-CD3/anti-CLL-1 bispecific antibody for the treatment of acute myeloid leukemia. Blood 129(5):609-618 (2017). Published online Dec. 1, 2016. doi:10.1182/blood-2016-08-735365.
Li et al. A Novel Bispecific Antibody, S-Fab, Induces Potent Cancer Cell Killing.J Immunother 38(9):350-356 (Nov./Dec. 2015).
Li et al. IFN-γ-induced chemokines are required for CXCR3-mediated T cell recruitment and anti-tumor efficacy of anti-HER2/CD3 bispecific antibody. Author Manuscript Published Online First on Jun. 27, 2018. 29 pages. DOI: 10.1158/1078-0432.CCR-18-1139.
Li et al. Prognostic Value of MMP-9 in Ovarian Cancer: A Meta-analysis. Asian Pacific Journal of Cancer Prevention 14:4107-4113 (2013). DOI: http://dx.doi.org/10.7314/APJCP.2013.14.7.4107.
Lum et al. Targeted T cell Therapy in Stage IV Breast Cancer: A Phase I Clinical Trial. Clin Cancer Res. Author Manuscript Published OnlineFirst on Feb. 16, 2015. 28 pages. DOI: 10.1158/1078-0432.CCR-14-2280.
Mathieu et al. Substrate specificity of schistosome versus human legumain determined by P1-P3 peptide libraries. Molecular & Biochemical Parasitology 121:99-105 (2002).
Mau-Sørensen et al. A phase I trial of intravenous catumaxomab: a bispecific monoclonal antibody targeting EpCAM and the T cell coreceptor CD3. Cancer Chemother Pharmacol 75:1065-1073 (2015). Published online Mar. 27, 2015. DOI 10.1007/s00280-015-2728-5.
McGowan et al. Matrix metalloproteinase expression and outcome in patients with breast cancer: analysis of a published database. Annals of Oncology 19:1566-1572 (2008). Published online May 23, 2008. doi:10.1093/annonc/mdn180.
Mehvar R. Modulation of the pharmacokinetics and pharmacodynamics of proteins by polyethylene glycol conjugation. J. Pharm Pharm Sci. 2000;3(1):125-136.
Meijer et al. Non FcR-binding murine antihuman CD3 monoclonal antibody is capable of productive TCR signalling and induces proliferation in the presence of costimulation. Clin Exp Immunol 123:511-519 (2001).
Melero et al. T-Cell and NK-Cell Infiltration into Solid Tumors: A Key Limiting Factor for Efficacious Cancer Immunotherapy. Cancer Discov 4(5):522-526 (May 2014). doi:10.1158/2159-8290.CD-13-0985.
Miller et al. Design, Construction, and In Vitro Analyses of Multivalent Antibodies. The Journal of Immunology 170:4854-4861 (2003).
Morgia et al. Matrix metalloproteinases as diagnostic (MMP-13) and prognostic (MMP-2, MMP-9) markers of prostate cancer. Urol Res 33:44-50 (2005). Published online Oct. 22, 2004. DOI 10.1007/s00240-004-0440-8.
Myers et al. Lewis Y Antigen as Detected by the Monocolonal Antibody BR96 is Expressed Strongly in Prostatic Adenocarcinoma. The Journal of Urology 153:1572-1574 (May 1995).
Nagase et al. Substrate specificities and activation mechanisms of matrix metalloproteinases. Biochemical Society Transactions 19:715-718 (1991).
Nam et al. Robust Therapeutic Efficacy of Matrix Metalloproteinase-2-Cleavable Fas-1-RGD Peptide Complex in Chronic Inflammatory Arthritis. PLoS ONE 11(10):e0164102 (Oct. 14, 2016). 18 pages. doi:10.1371/journal.pone.0164102.
Notice of opposition dated Feb. 13, 2014 by Novo Nordisk filed Feb. 7, 2014 against EP1996220 Application No. 07752636.6.
Notice of opposition dated Feb. 17, 2014 by XL-protein GmbH filed Feb. 7, 2014 against EP1996220 Application No. 07752636.6.
Notice of opposition dated Aug. 18, 2015 by Novo Nordisk filed Aug. 13, 2015 against EP2402754 Application No. 11172812.7.
Notice of opposition dated Aug. 21, 2015 by XL-protein GmbH filed Aug. 18, 2015 against EP2402754 Application No. 11172812.7.
Oberst et al. CEA/CD3 bispecific antibody MEDI-565/AMG 211 activation of T cells and subsequent killing of human tumors is independent of mutations commonly found in colorectal adenocarcinomas. mAbs 6(6):1571-1584 (Nov./Dec. 2014).
Oberst et al. Expression of the Serine Protease Matriptase and Its Inhibitor HAI1 in Epithelial Ovarian Cancer: Correlation with Clinical Outcome and Tumor Clinicopathological Parameters. Clinical Cancer Research 8:1101-1107 (Apr. 2002).
Offner et al. Induction of regular cytolytic T cell synapses by bispecific single-chain antibody constructs on MHC class I-negative tumor cells. Molecular Immunology 43:763-771 (2006). Available online Apr. 26, 2005. doi:10.1016/j.molimm.2005.03.007.
Omidfar et al. Production of a novel camel single-domain antibody specific for the type III mutant EGFR. Tumour Biol 25(5-6):296-305 (Sep.-Dec. 2004). DOI: 10.1159/000081395.
Pan et al. Identification of Peptide Substrates for Human MMP-11 (Stromelysin-3) Using Phage Display. J Biol Chem 278(30):27820-27827 (Jul. 25, 2003). Published, JBC Papers in Press, May 8, 2003, DOI 10.1074/jbc.M304436200.
Pei et al. Hydrolytic Inactivation of a Breast Carcinoma Cell-derived Serpin by Human Stromelysin-3. J Biol Chem 269 (41):25849-25855 (Oct. 14, 1994).
Pessano et al. The T3/T cell receptor complex: antigenic distinction between the two 20-kd T3 (T3-delta and T3-epsilon) subunits. The EMBO Journal 4(2):337-344 (1985).
Podust, et al. Extension of in vivo half-life of biologically active molecules by XTEN protein polymers. J Control Release. Oct. 28, 2016;240:52-66. doi: 10.1016/j.jconrel.2015.10.038. Epub Oct. 30, 2015.
Ranuncolo et al. Plasma MMP-9 (92 kDa-MMP) Activity is Useful in the Follow-Up and in the Assessment of Prognosis in Breast Cancer Patients. Int J Cancer 106:745-751 (2003). DOI 10.1002/ijc.11288.
Ross et al. Bispecific T cell engager (BiTE®) antibody constructs can mediate bystander tumor cell killing. PLoS ONE 12(8): e0183390 (Aug. 24, 2017). https://doi.org/10.1371/journal.pone.0183390.
Rossi et al. A new class of bispecific antibodies to redirect T cells for cancer immunotherapy. mabs 6(2):381-391; Mar./Apr. 2014.
Rossi et al. Redirected T-Cell Killing of Solid Cancers Targeted with an Anti-CD3/Trop-2 Bispecific Antibody is Enhanced in Combination with Interferon-α. American Association for Cancer Research. Author Manuscript Published OnlineFirst on Jul. 22, 2014; DOI: 10.1158/1535-7163.MCT-14-0345. 34 pages.
Rossi et al. Differential antibody binding to the surface αβTCR•CD3 complex of CD4+ and CD8+ T lymphocytes is conserved in mammals and associated with differential glycosylation. International Immunology 20(10):1247-1258 (Oct. 2008). Advance Access publication Jul. 24, 2008. DOI: https://doi.org/10.1093/intimm/dxn081.
Ruiz et al. p95HER2-T cell bispecific antibody for breast cancer treatment. Sci Transl Med 10: eaat1445 (Oct. 3, 2008). 12 pages.
Sandersjöö et al. A new prodrug form of Affibody molecules (pro-Affibody) is selectively activated by cancer-associated proteases. Cell. Mol. Life Sci. 72:1405-1415 (2015). Published online Oct. 7, 2014. DOI 10.1007/s00018-014-1751-8.
Savariar et al. Real-time In Vivo Molecular Detection of Primary Tumors and Metastases with Ratiometric Activatable Cell-Penetrating Peptides. Cancer Research 73(2):855-864 (2012). Published OnlineFirst Nov. 27, 2012; DOI: 10.1158/0008-5472.CAN-12-2969.
Schellenberger, V. Engineering of Microproteins for Pharmaceutical Applications. PowerPoint Presentation. (2006). Opposition by XL-Protein GmbH against EP2402754 Application No. 11172812.7.

(56) References Cited

OTHER PUBLICATIONS

Scheuer et al. Strongly Enhanced Antitumor Activity of Trastuzumab and Pertuzumab Combination Treatment on HER2-Positive Human Xenograft Tumor Models. Cancer Res 69(24):9330-9336 (Dec. 15, 2009).
Schlereth et al. Potent inhibition of local and disseminated tumor growth in immunocompetent mouse models by a bispecific antibody construct specific for Murine CD3. Cancer Immunol Immunother 55: 785-796 (2006). Published online Sep. 27, 2005. DOI 10.1007/s00262-005-0082-x.
Schlereth et al. T-cell activation and B-cell depletion in chimpanzees treated with a bispecific anti-CD19/anti-CD3 single-chain antibody construct. Cancer Immunol Immunother 503-514 (2006). Published online Jul. 20, 2005. DOI 10.1007/s00262-005-0001-1.
Schmalfeldt et al. Increased Expression of Matrix Metalloproteinases (MMP)-2, MMP9, and the Urokinase-Type Plasminogen Activator Is Associated with Progression from Benign to Advanced Ovarian Cancer. Clinical Cancer Research 7:2396-2404 (Aug. 2001).
Senter et al. Selective activation of anticancer prodrugs by monoclonal antibody-enzyme conjugates. Advanced Drug Delivery Reviews 53:247-264 (2001).
Shekhar. Double Whammy: Bispecific Antibodies Help Immune Cells Attack Tumors. Chemistry & Biology, vol. 15 (Sep. 22, 2008). 2 pages. DOI 10.1016/j.chembiol.2008.09.002.
Sier et al. Tissue levels of matrix metalloproteinases MMP-2 and MMP-9 are related to the overall survival of patients with gastric carcinoma. British Journal of Cancer 74:413-417 (1996).
Slaga et al. Avidity-based binding to HER2 results in selective killing of HER2-overexpressing cells by anti-HER2/CD3. Sci Transl Med 10:eaat5775 (Oct. 17, 2018). 11 pages.
Stamova et al. Simultaneous engagement of the activatory receptors NKG2D and CD3 for retargeting of effector cells to CD33-positive malignant cells. Leukemia 25:1053-1056 (2011). Published online Mar. 18, 2011. doi:10.1038/leu.2011.42.
Stone et al. A sensitivity scale for targeting T cells with chimeric antigen receptors (CARs) and bispecific T-cell engagers (BiTEs). OncoImmunology 1(6):863-873 (Sep. 2012). http://dx.doi.Org/10.4161/onci.20592.
Sun, et al. Anti-CD20/CD3 T cell-dependent bispecific antibody for the treatment of B cell malignancies. Sci Transl Med. May 13, 2015;7(287):287ra70. 11 pages, doi: 10.1126/scitranslmed.aaa4802.
Taberno et al. Phase I studies of the novel carcinoembryonic antigen CD3 T-cell bispecific (CEA-TCB) antibody as a single agent and in combination with atezolizumab: preliminary efficacy and safety in patients with metastatic colorectal cancer (mCRC). Slides. 2017 American Society of Clinical Oncology (ASCO) Annual Meeting, Jun. 2-5, 2017. 19 pages.
TEPITOPE analysis for SAPA repeats of opposition cited reference D5 Buscaglia et al. (1999) Blood 93:2025-2032 by Novo Nordisk against EP2402754 Application No. 11172812.7.
Tian, et al. Expression of CD147 and matrix metalloproteinase-11 in colorectal cancer and their relationship to clinicopathological features. J Transl Med. 2015; 13: 337. 11 pages.
Van Nagell, Jr et al. The Clinical Significance of Carcinoembryonic Antigen in the Plasma and Tumors of Patients with Gynecologic Malignancies. Cancer 42:1527-1532 (1978).
Walsh G. Appendix 1—Biopharmaceuticals thus far approved in the USA or European Union. Biopharmaceuticals: Biochemistry and Biotechnology. Second Edition. John Wiley & Sons. 25 pages.
Yuen, et al., A long-acting human growth hormone with delayed clearance (VRS-317): results of a double-blind, placebo-controlled, single ascending dose study in growth hormone-deficient adults. J Clin Endocrinol Metab. Jun. 2013, 98(6), 2595-2603.
Cleland et al., "A novel long-acting human growth hormone fusion protein (VRS-317): enhanced in vivo potency and half-life," J. Pharm. Sci., vol. 101 (8); 2744-2754, (2012).
Ding et al., "Multivalent Antiviral XTEN-Peptide Conjugates with Long in Vivo Half-Life and Enhanced Solubility," Bioconjugate Chemistry, 25(7): 1351-1359, (2014).
Martin, S. et al. "TreatemIn of Malignant Pleural Effusion with the Trifunctional Antibody Catumaxomab (Removab) (Anti-EpCAM x Anti-CD3) Results of a Phase 1/2 Study" J immunotherapy 32(2) 195-202 (2009).
Metz et al. "Bispecific antibody derivatives with restricted binding functionalities that are activated by proteolytic processing", Protein Engineering, Design, & Selection 25(10) 571-580 (2012).
Podust et al., "Extension of in vivo half-life of biologically active peptides via chemical conjugation to XTEN protein polymer," Protein Eng. Des. Sei., 26(11): 743-753 (2013).
Sim BC, "AMX-168, long-acting, tumor protease-sensitive bispecific precursor for the treatment of solid malignancies" Cancer Research Abstract 3638 (2017).
Suurs et al. "A review of bispecific antibodies and antibody constructs in oncology and clinical challenges", Pharmacology & Therapeutics 201:103-119 (2019).
Zhang, P. et al. "An EpCam/CD3 Bispecific antibody efficiently eliminates hepatocellular carcinoma cells with limited galectin-1 expression" Cancer Immunology, Immunotherapy 63(2) 121-132 (2014).
Anoymous: XTEN Trademark of Amunix Operating Inc. Registration No. 4871664-Serial No. 86395983.
International Search Report and Written Opinion of the International Searching Authority, dated Feb. 27, 2017 in International Application No. PCT/US2016/049137.
Written Opinion of the International Preliminary Examining Authority, dated Feb. 27, 2017 in International Application No. PCT/US2016/049137.
Arnau et al. Current strategies for the use of affinity tags and tag removal for the purification of recombinant proteins. Protein ExprPurif., 2006, 48(1):1-13.
Babson et al. Protein transfer in tumor-bearing rats. Cancer Res 14:606-611 (1954).
Balzar et al. The biology of the 17-1A antigen (Ep-CAM), J. Mol. Med. 1999, 77:699-712.
Calceti et al., 2003. Pharmacokinetic and biodistribution properties of poly(ethylene glycol)-protein conjugates. Adv Drug Deliv Rev 55:1261-1277.
Chang et al., Phenotypic expression in E. coli of a DNA sequence coding for mouse dihydrofolate reductase. Nature, 275:615 (1978).
Chatenoud, CD3-specific antibody-induced active tolerance: from bench to bedside. Nat. Rev. Immunol., 3:123-132 (2003).
De Boer et al. The tac promoter: a functional hybrid derived from the trp and lac promoters. Proc Natl Acad Sci, 1983, 80:21-25.
Duran-Reynals, Studies on the localization of dyes and foreign proteins in normal and malignant tissue. Am J Cancer 35:98-107 (1939).
Extended European Search Report for European Patent Application No. 22181008.8, dated Dec. 15, 2022.
Ferrari et al. Solitomab, an EpCAM/CD3 bispecific antibody construct (BiTE), is highly active against primary uterine and ovarian carcinosarcoma cell lines in vitro. J Exp Clin Cancer Res. 2015, 34:123.
Garnier et al. (1996), GOR method for predicting protein scondary structure from amino acid sequence. Methods Enzymol 266:540-553.
Gastl et al., Ep-CAM overexpression in breast cancer as a predictor of survival. Lancet, 2000, 356, 1981-1982.
Goeddel et al., Direct expression in Escherichia coli of a DNA sequence coding for human growth hormone. Nature, 281:544-548 (1979).
Goeddel et al., Synthesis of human fibroblast interferon by E. coli. Nucleic Acids Res., 8:4057-4074 (1980).
Goitlinger et al., The epithelial cell surface antigen 17-1 A, a target for antibody-mediated tumor therapy: Its biochemical nature, tissue distribution and recognition by different monoclonal antibodies. Int J Cancer. 1986; 38, 47-53.
Helfrich et al. Construction and characterization of a bispecific diabody for retargeting T cells to human carcinomas. Int. J. Cancer, 1998, 76:232-239.

(56) References Cited

OTHER PUBLICATIONS

Kimball et al., The OKT3 Antibody Response Study: a multicentre study of human anti-mouse antibody (HAMA) production following OKT3 use in solid organ transplantation. Transplant Immunol. 3:212-221 (1995).
Kumar et al., ATGAM versus OKT3 induction therapy in cadaveric kidney transplantation: patient and graft survival, CD3 subset, infection, and cost analysis. Transplant Proc. 30:1351-1352 (1998).
Lee et al. Current concepts in the diagnosis and management of cytokine release syndrome. Blood, 2014, 124(2):188-195.
Mack, Small bispecific antibody composition expressed as a functional single-chain molecule with high tumor cell cytotoxicity. Proc. Natl. Acad. Sci., 1995, 92:7021-7025.
Martin, Expression of the 17-1A antigen in gastric and gastro-oesophageal junction adenocarcinomas: a potential immunotherapeutic target? J Clin Pathol 1999; 52:701-704.
Matsumura, A new concept for macromolecular therapeutics in cancer chemotherapy: mechanism of tumoritropic accumulation of proteins and the antitumor agent smancs. Cancer Res 46:6387-6392 (1986).
Metz, Bispecific antibody derivatives with restricted binding functionalities that are activated by proteolytic processing, Protein Engineering, Design & Selection, 2012, 25(10): 571-580.
Möller et al., Bispecific-monoclonal-antibody-directed lysis of ovarian carcinoma cells by activated human T lymphocytes. Cancer Immunol. Immunother. 33:210-216, 1991.
Munz, Side-by-side analysis of five clinically tested anti-EpCAM monoclonal antibodies, Cancer Cell International, 10:44-56, 2010.
Packeisen et al., Detection of surface antigen 17-1A in breast and colorectal cancer. Hybridoma. 1999 18(1):37-40.
Passlick et al. The 17-1A antigen is expressed on primary, metastatic and disseminated nonsmall cell lung carcinoma cells. Int. J. Cancer 87(4):548-552, 2000.
Romagnani, T-cell subsets (Th1 versus Th2). Ann Allergy Asthma Immunol. 2000, 85(1):9-18.
Sarin et al. Physiologic upper limit of pore size in the blood-tumor barrier of malignant solid tumors. J. Translational Medicine 2009 7:51.
Sarin, Physiologic upper limits of pore size of different blood capillary types and another perspective on the dual pore theory of microvascular permeability. J Angiogenes Res. 2010; 2:14.
Sgro, Side-effects of a monoclonal antibody, muromonab CD3/orthoclone OKT3: bibliographic review. Toxicology 105:23-29, 1995.
Shalaby et al. Development of humanized bispecific antibodies reactive with cytotoxic lymphocytes and tumor cells overexpressing the HER2 protooncogene. J. Exp. Med. 175, 217-225 (1992).
Simon et al. Epithelial glycoprotein is a member of a family of epithelial cell surface antigens homologous to nidogen, a matrix adhesion protein. Proc. Natl. Acad. Sci., 1990, 87: 2755-2759.
Smith et al. Nonmitogenic Anti-CD3 Monoclonal Antibodies Deliver a Partial T Cell Receptor Signal and Induce Clonal Anergy, J. Exp. Med. 185:1413-1422 (1997).
Smith et al., Single-Step Purification of Polypeptides Expressed in Escherichia coli as Fusions with Glutathione S-Transferase. Gene 67:31-40 (1988).
Squire, Calculation of hydrodynamic parameters of random coil polymers from size exclusion chromatography and comparison with parameters by conventional methods. Journal of Chromatography, 1981, 5, 433-442.
Tanford et al., Proteins in 6 M Guanidine Hydrochride. (1966) J. Biol. Chem. 241, 1921-1923.
Tunnacliffe, The majority of human CD3 epitopes are conferred by the epsilon chain, Int'l. Immunol., 1989, 1(5): 546-650.
Yoon, Selective addition of CXCR3+CCR4-CD4+ Th1 cells enhances generation of cytotoxic T cells by dendritic cells in vitro. Exp Mol Med. 2009. 41(3):161-170.
Zeidler et al. Simultaneous Activation of T Cells and Accessory Cells by a New Class of Intact Bispecific Antibody Results in Efficient Tumor Cell Killing. J. Immunol., 1999, 163: 1246-1252.
Zimmerman et al. Unleashing the clinical power of T cells: CD19/CD3 bispecific T cell engager (BiTE) antibody composition blinatumomab as a potential therapy. Int. Immunol. (2015) 27(1): 31-37.

\* cited by examiner

 ECA — Effector Cell Antigen — An antigen (receptor) on the surface of an Effector Cell

 ECBM — Effector Cell Binding Moiety — Binding Moiety (protein domain, peptide, synthetic ligand) that binds specifically to the Effector Cell Antigen

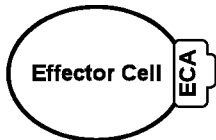 Effector Cell — Effector Cell — A cell that is capable of killing or inhibiting at tumor cell or a cell that is part of tumor tissue. Effector Cells can be T-cells, NK cells.

 TA — Tumor Antigen — An antigen (receptor) that is overexpressed on cells that from a tumor.

 TABM — Tumor Antigen Binding Moiety — A binding moiety (protein domain, peptide, synthetic ligand) that binds specifically to a tumor antigen.

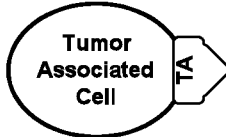 Tumor Associated Cell — Tumor Associated Cell — A cell that is part of a tumor. This can be a tumor cell or other cell types such as stroma that form a tumor mass.

 Bulking Moiety — Bulking Moiety — Bulking Moiety is a protein or polymer that has a larger size than the ECBM and the TABM. The BD can be albumin, an albumin binding domain, Fc, PEG, XTEN

 XTEN

RS — Release Site — Release Site is an amino acid sequence that can be cleaved by a tumor associated protease.

 Tumor Associated Protease — Tumor Associated Protease is an proteolytic enzyme that occurs in the extracellular space of tumor tissue.

ProTIA — Protease Triggered Immune Activator

ProTIA in pro-form — ProTIA molecule prior to protease-catalyzed trigger event

ProTIA in apo-form — ProTIA molecule that has lost its bulking domain due to a protease-catalyzed trigger event

FIG. 1

Generic Construct Design

Tandem scFv Constructs

Diabody Constructs

Retention Time (min)

```
DIQMTQSPSSLSASVGDRVTITCRSTKSLLHSNGITYLYWYQQKPGKAPKL
LIYQMSNLASGVPSRFSSSGSGTDFTLTISSLQPEDFATYYCAQNLEIPRT
FGQGTKVEIKGATPPETGAETESPGETTGGSAESEPPGEGQVQLVQSGPGL
VQPGGSVRISCAASGYTFTNYGMNWVKQAPGKGLEWMGWINTYTGESTYAD
SFKGRFTFSLDTSASAAYLQINSLRAEDTAVYYCARFAIKGDYWGQGTLLT
VSSGGGGSDIQMTQSPSSLSASVGDRVTITCRASQDIRNYLNWYQQKPGKA
PKLLIYYTSRLESGVPSRFSGSGSGTDYTLTISSLQPEDFATYYCQQGNTL
PWTFGQGTKVEIKGATPPETGAETESPGETTGGSAESEPPGEGEVQLVESG
GGLVQPGGSLRLSCAASGYSFTGYTMNWVRQAPGKGLEWVALINPYKGVST
YNQKFKDRFTISVDKSKNTAYLQMNSLRAEDTAVYYCARSGYYGDSDWYFD
VWGQGTLVTVSSGTAEAASASGLSGRSDNHSPLGLAGSPGSPAGSPTSTEE
GTSESATPESGPGTSTEPSEGSAPGSPAGSPTSTEEGTSTEPSEGSAPGTS
TEPSEGSAPGTSESATPESGPGSEPATSGSETPGSEPATSGSETPGSPAGS
PTSTEEGTSESATPESGPGTSTEPSEGSAPGTSTEPSEGSAPGSPAGSPTS
TEEGTSTEPSEGSAPGTSTEPSEGSAPGTSESATPESGPGTSTEPSEGSAP
GTSESATPESGPGSEPATSGSETPGTSTEPSEGSAPGTSTEPSEGSAPGTS
ESATPESGPGTSESATPESGPGSPAGSPTSTEEGTSESATPESGPGSEPAT
SGSETPGTSESATPESGPGTSTEPSEGSAPGTSTEPSEGSAPGTSTEPSEG
SAPGTSTEPSEGSAPGTSTEPSEGSAPGTSTEPSEGSAPGSPAGSPTSTEE
GTSTEPSEGSAPGTSESATPESGPGSEPATSGSETPGTSESATPESGPGSE
PATSGSETPGTSESATPESGPGTSTEPSEGSAPGTSESATPESGPGSPAGS
PTSTEEGSPAGSPTSTEEGSPAGSPTSTEEGTSESATPESGPGTSTEPSEG
SAPGTSESATPESGPGSEPATSGSETPGTSESATPESGPGSEPATSGSETP
GTSESATPESGPGTSTEPSEGSAPGSPAGSPTSTEEGTSESATPESGPGSE
PATSGSETPGTSESATPESGPGSPAGSPTSTEEGSPAGSPTSTEEGTSTEP
SEGSAPGTSESATPESGPGTSESATPESGPGTSESATPESGPGSEPATSGS
ETPGSEPATSGSETPGSPAGSPTSTEEGTSTEPSEGSAPGTSTEPSEGSAP
GSEPATSGSETPGTSESATPESGPGTSTEPSEGSAPGHHHHHH
```

FIG. 36

```
DIVMTQSPLSLPVTPGEPASISCRSSKNLLHSNGITYLYWYLQKPGQSPQL
LIYQMSNLASGVPDRFSSSGSGTDFTLKISRVEAEDVGVYYCAQNLEIPRT
FGQGTKVEIKGATPPETGAETESPGETTGGSAESEPPGEGQVQLVQSGPEV
KKPGASVKVSCKASGYTFTNYGMNWVRQAPGQGLEWMGWINTYTGEPTYGE
DFKGRFAFSLDTSASTAYMELSSLRSEDTAVYFCARFGNYVDYWGQGSLVT
VSSGGGGSELVVTQEPSLTVSPGGTVTLTCRSSTGAVTTSNYANWVQQKPG
QAPRGLIGGTNKRAPGTPARFSGSLLGGKAALTLSGVQPEDEAEYYCALWY
SNLWVFGGGTKLTVLGATPPETGAETESPGETTGGSAESEPPGEGEVQLLE
SGGGLVQPGGSLKLSCAASGFTFNTYAMNWVRQAPGKGLEWVARIRSKYNN
YATYYADSVKDRFTISRDDSKNTAYLQMNNLKTEDTAVYYCVRHGNFGNSY
VSWFAYWGQGTLVTVSSGTAEAASASGLSGRSDNHSPLGLAGSPGSPAGSP
TSTEEGTSESATPESGPGTSTEPSEGSAPGSPAGSPTSTEEGTSTEPSEGS
APGTSTEPSEGSAPGTSESATPESGPGSEPATSGSETPGSEPATSGSETPG
SPAGSPTSTEEGTSESATPESGPGTSTEPSEGSAPGTSTEPSEGSAPGSPA
GSPTSTEEGTSTEPSEGSAPGTSTEPSEGSAPGTSESATPESGPGTSTEPS
EGSAPGTSESATPESGPGSEPATSGSETPGTSTEPSEGSAPGTSTEPSEGS
APGTSESATPESGPGTSESATPESGPGSPAGSPTSTEEGTSESATPESGPG
SEPATSGSETPGTSESATPESGPGTSTEPSEGSAPGTSTEPSEGSAPGTST
EPSEGSAPGTSTEPSEGSAPGTSTEPSEGSAPGTSTEPSEGSAPGSPAGSP
TSTEEGTSTEPSEGSAPGTSESATPESGPGSEPATSGSETPGTSESATPES
GPGSEPATSGSETPGTSESATPESGPGTSTEPSEGSAPGTSESATPESGPG
SPAGSPTSTEEGSPAGSPTSTEEGSPAGSPTSTEEGTSESATPESGPGTST
EPSEGSAPGTSESATPESGPGSEPATSGSETPGTSESATPESGPGSEPATS
GSETPGTSESATPESGPGTSTEPSEGSAPGSPAGSPTSTEEGTSESATPES
GPGSEPATSGSETPGTSESATPESGPGSPAGSPTSTEEGSPAGSPTSTEEG
TSTEPSEGSAPGTSESATPESGPGTSESATPESGPGTSESATPESGPGSEP
ATSGSETPGSEPATSGSETPGSPAGSPTSTEEGTSTEPSEGSAPGTSTEPS
EGSAPGSEPATSGSETPGTSESATPESGPGTSTEPSEGSAPGHHHHHH
```

FIG. 37

- ■ Protease-treated aHER2 x aCD3 ProTIA on HER2 coated on plate
- ▲ Protease-treated aCEA x aCD3 ProTIA on CEA coated on plate
- ● Protease-treated aEpCAM x aCD3 ProTIA on EpCAM coated on plate
- ○ Protease-treated aEpCAM x aCD3 ProTIA on HER2 coated on plate
- ⊗ Protease-treated aEpCAM x aCD3 ProTIA on CEA coated on plate

CHIMERIC POLYPEPTIDE ASSEMBLY AND METHODS OF MAKING AND USING THE SAME

CROSS REFERENCES

This application is a National Stage Entry of PCT/US2016/049137, filed on Aug. 26, 2016, which claims the benefit of U.S. Provisional Pat. Appl. No. 62/211,532, filed Aug. 28, 2015 and U.S. Prov. Appl. No. 62/263,319, filed Dec. 4, 2015, U.S. Prov. Appl. No. 62/278,755, filed Jan. 14, 2016, U.S. Prov. Appl. No. 62/338,285, filed May 18, 2016, U.S. Prov. Appl. No. 62/363,046, filed Jul. 15, 2016, and U.S. Provisional Appl. No. 62/379,673, filed Aug. 25, 2016. Each of these applications are hereby incorporated by reference in their entireties.

SEQUENCE LISTING

The instant application contains a Sequence Listing which has been submitted electronically in ASCII format and is hereby incorporated by reference in its entirety. Said ASCII copy, created on Jan. 7, 2019, is named 32808-755_831_SL.txt and is 1,191,610 bytes in size.

BACKGROUND OF THE INVENTION

Many approved cancer therapeutics are cytotoxic drugs that kill normal cells as well as tumor cells. The therapeutic benefit of these cytotoxic drugs depends on tumor cells being more sensitive than normal cells, thereby allowing clinical responses to be achieved using doses that do not result in unacceptable side effects. However, essentially all of these non-specific drugs result in some if not severe damage to normal tissues, which often limits treatment suitability.

Bispecific antibodies offer a different approach to cytotoxic drugs in that they direct immune effector cells to kill cancer cells. Bispecific antibodies combine the benefits of different binding specificities derived from two monoclonal antibodies into a single composition, enabling approaches or combinations of coverages that are not possible with monospecific antibodies. This approach relies on binding of one arm of the bispecific antibody to a tumor-associated antigen or marker, while the other arm, upon binding the CD3 molecule on T cells, triggers their cytotoxic activity by the release of effector molecules such as such as TNF-α, IFN-γ, interleukins 2, 4 and 10, perforin, and granzymes. Advances in antibody engineering have led to the development of a number of bispecific antibody formats and compositions for redirecting effector cells to tumor targets, including Bispecific T-cell Engagers (BiTEs®) such as blinatumomab. BiTEs function by recruiting and activating polyclonal populations of T-cells at tumor sites, and do so without the need for co-stimulation or conventional MHC recognition. There remains, however, the dual problems of certain patients experiencing serious side effects referred to as "cytokine storm" or "cytokine release syndrome" (Lee D W et al. Current concepts in the diagnosis and management of cytokine release syndrome. Blood. 2014 124(2):188-195) mediated by the release of TNF-α and IFN-γ, amongst other cytokines, in addition to the fact that BiTE compositions have a very short half-life, necessitating continuous infusions of four to eight weeks in order to maintain BiTE within the therapeutic window for sufficient time to achieve a therapeutic effect.

SUMMARY OF THE INVENTION

There remains a considerable need for alternative therapeutics that offer the pharmacologic advantages of such bispecific antibody formats but with increased safety, reduced side effects, increased selectivity, and/or enhanced pharmacokinetic properties, such as requiring less frequent dosing or merely dosing by a single injection.

The present invention discloses a chimeric polypeptide assembly useful in the treatment or prevention of diseases, including but not limited to cancers, autoimmune, and inflammatory disorders. In a first aspect, the present disclosure provides a cleaveable chimeric polypeptide assembly. The cleavable chimeric polypeptide assembly compositions address an unmet need and are superior in one or more aspects including enhanced terminal half-life, targeted delivery, and reduced toxicity to healthy tissues compared to conventional bispecific antibody preparations in use.

A subject polypeptide assembly typically comprises a first portion, a second portion, and a third portion, wherein: said first portion comprises (i) a first binding domain with binding specificity to a target cell marker; and (ii) a second binding domain with binding specificity to an effector cell antigen; said second portion comprises a peptidyl release segment (RS) capable of being cleaved by one or more mammalian proteases; and said third portion comprises a bulking moiety; wherein said bulking moiety is capable of being released from said first portion by action of said mammalian protease on said second portion.

The various components in a subject chimeric polypeptide assembly can be configured in a variety of different orders. In one embodiment, the chimeric polypeptide assembly is configured, from N-terminus to C-terminus, wherein the first portion is linked to the second portion, which in turn is linked to the third portion. In another embodiment, the chimeric polypeptide assembly is configured, from N-terminus to C-terminus, wherein the third portion is linked to the second portion, which in turn is linked to the first portion. In one embodiment, the chimeric polypeptide assembly is a fusion protein. In another embodiment, the second and third portions are a fusion protein and the first portion is conjugated to the second portion. In one embodiment of the chemically conjugated polypeptide assembly composition, the C-terminus of the first portion polypeptide can be conjugated to the N-terminus of the second portion polypeptide via a cysteine or other suitable amino acids amenable for cross-linking by agents such as maleamide or other cross-linking agents known in the art. In another embodiment, the first portion and the second portion is a monomeric fusion protein and the third portion is chemically conjugated to the second portion.

Optionally, the chimeric polypeptide assembly compositions may comprise an additional bulking moiety linked to the composition by a second release segment linked to the opposite end of the composition, thereby enclosing the first and second portions.

The first and the second binding domains are generally antibody fragments derived from monoclonal antibodies. In one embodiment, the first and the second binding domains of the first portion of the chimeric polypeptide assembly compositions are scFv or configured as a diabody. In other embodiments, the first and the second binding domains of the first portion of the chimeric polypeptide assembly compositions are selected from the group consisting of Fv, Fab, Fab', Fab'-SH, F(ab')2, linear antibodies, a single domain antibody, a non-antibody scaffold, and a single domain camelid antibody. In other embodiments, the first and the second binding domains of the first portion of the chimeric polypeptide assembly compositions are selected from the group of peptides, non-antibody scaffolds such as anticalins, adnectins, fynomers, affilins, affibodies, centyrins, DARPins. In other embodiments the binding domain for the tumor cell target is a variable domain of a T cell receptor that has been engineered to bind MHC that is loaded with a peptide fragment of a protein that is overexpressed by tumor cells.

In one embodiment of the chimeric polypeptide assembly, the first binding domain of the first portion has binding affinity to a target cell marker. Target cells include any cell types of eukaryotes such as those of ectoderm, mesoderm or endoderm origin. Of particular interest are tumor cells and markers expressed by the tumor cells. Tumor cell can arise from a cell selected from the group consisting of stromal cell, fibroblasts, myofibroblasts, glial cells, epithelial cells, fat cells, lymphocytic cells, vascular cells, smooth muscle cells, mesenchymal cells, breast tissue cells, prostate cells, kidney cells, brain cells, colon cells, ovarian cells, uterine cells, bladder cells, skin cells, stomach cells, genito-urinary tract cells, cervix cells, uterine cells, small intestine cells, liver cells, pancreatic cells, gall bladder cells, bile duct cells, esophageal cells, salivary gland cells, lung cells, and thyroid cells. In some cases, the tumor specific marker include alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. In another embodiment of the chimeric polypeptide assembly, the first binding domain of the first portion has binding affinity to a target cell marker that is an inflammatory marker.

In one embodiment, the first binding domain of the first portion of the chimeric polypeptide assembly compositions comprises VH and VL regions with specific binding affinity to a tumor-specific marker or an antigen of a target cell. In one embodiment of the foregoing, the first binding domain VH and VL are derived from a monoclonal antibody VH and VL selected from the group of paired sequences set forth in Table 2. The VH and VL regions of the first and second binding domains can be configured in different orders, with respect to the N-terminus to C-terminus order. In one embodiment, the first binding domain VH and VL regions are arranged in the order VH-VL. In another embodiment, the first binding domain VH and VL regions are arranged in the order VL-VH. In other cases, the first binding domain comprises a CDR-H1 region, a CDR-H2 region, a CDR-H3 region, a CDR-L1 region, a CDR-L2 region, and a CDR-H3 region, wherein each of said regions is derived from monoclonal antibody sequences selected from the group of sequences set forth in Table 2. The various configurations of VH and VL regions as well as the CDRs contained therein typically retain the desired binding specificity to an intended target cell marker.

In other embodiments of the chimeric polypeptide assembly, the second binding domain of the first portion has binding affinity to an effector cell. Where desired, the effector cell can be immune cells, including but not limited to plasma cell, T cell, B cell, cytokine induced killer cell (CIK cell), master cell, dendritic cell, regulatory T cell (RegT cell), helper T cell, myeloid cell, and NK cell. The second binding domain typically exhibits binding specificity to an antigen expressed by an effector cell. In some embodiments, the antigen is expressed on the cell surface of an effector cell. In another embodiment, the second binding domain has binding specificity to an effector cell antigen expressed on a T cell. Non-limiting exemplary effector cell antigens include CD3, CD4, CD8, αβ TCR, CD25, CD45RO, CD69, CD127, and CD196 (CCR6). Of particular interest is a second binding domain adopting a scFv configuration having VH and VL regions derived from a monoclonal antibody that binds specifically to human CD3. In one embodiment, the second binding domain VH and VL are derived from a monoclonal antibody VH and VL selected from the group of sequences set forth in Table 1. In another embodiment, the second binding domain comprises VH and VL regions derived from a monoclonal antibody capable of binding human CD3ε.

The VH and VL of the scFv of the binding domains can be arranged in different configurations without affecting the utility of the resulting composition. In one embodiment, the second binding domain scFv comprises VH and VL regions arranged in the order VH-VL or VL-VH in the N-terminal to C-terminal direction. The binding domains can also be created from CDR regions. In one embodiment, the second binding domain comprises a CDR-H1 region, a CDR-H2 region, a CDR-H3 region, a CDR-L1 region, a CDR-L2 region, and a CDR-H3 region, wherein each is derived from a monoclonal antibody of Table 1. In the foregoing embodiments of the paragraph, the VH and VL regions and the first binding domain and the second binding domain are linked by flexible polypeptide linkers selected from the group of sequences set forth in Table 8 and Table 9. In another embodiment, the first portion of the chimeric polypeptide assembly compositions has a sequence with at least about 90%, or 91%, or 92%, or 93%, or 94%, or 95%, or 96%, or 97%, or 98%, or 99% identity to a sequence selected from the group consisting of the sequences of Table 13.

One advantage of the subject chimeric polypeptide assembly is that it is assembled in form of a prodrug, wherein the intact composition can be activated in proximity to a target tissue or a certain cellular environment in which mammalian proteases are present, releasing the first portion binding domains at the site where its activity is most desirable. For example, the first portion binding domain, when present in the intact assembly, has lower binding affinity due to the shielding effect of the bulking moiety. Upon release via cleaveage of the RS by a mammalian protease preferentially expressed in a target issue, for example, a tumor tissue, the first portion binding domain becomes "activated" without being shielded by the bulking moiety. In another embodiment, the invention provides a chimeric polypeptide assembly, wherein the mammalian protease capable of cleaving the RS is preferentially expressed in an inflammatory tissue.

In one embodiment, the chimeric polypeptide assembly comprises an RS, wherein the RS comprises an amino acid sequence selected from the group consisting of the sequences set forth in Table 4. Where desired, the RS comprises an amino acid sequence selected from the group consisting of the sequences LSGRSDNHSPLGLAGS (SEQ ID NO: 1), SPLGLAGSLSGRSDNH (SEQ ID NO: 2), SPLGLSGRSDNH (SEQ ID NO: 3), LAGRSDNHSPLGLAGS (SEQ ID NO: 4), LSGRSDNHVPLSLKMG (SEQ ID NO: 5), SPLGLAGS (SEQ ID NO: 6), GPLALARG (SEQ ID NO: 7), LSGRSDNH (SEQ ID NO: 8), VPLSLTMG (SEQ ID NO: 9), VPLSLKMG (SEQ ID NO: 10), VPLSLSMG (SEQ ID NO: 11), EPLELVAG (SEQ ID NO: 12), EPLELRAG (SEQ ID NO: 13), EPAALMAG (SEQ ID NO: 14), EPASLMAG (SEQ ID NO: 15), RIGSLRTA (SEQ ID NO: 16), RIQFLRTA (SEQ ID NO: 17), EPFHLMAG (SEQ ID NO: 18), VPLSLFMG (SEQ ID NO: 19), EPLELPAG (SEQ ID NO: 20), and EPLELAAG (SEQ ID NO: 21). Where desired, the release segment of the chimeric polypeptide assembly composition comprises the amino acid sequence the sequence LSGRSDNHSPLGLAGS (SEQ ID NO: 1). In the RS embodiments, the RS comprises an amino acid sequence capable of being cleaved by one or more proteases selected from the group consisting of the proteases set forth in Table 3.

In another aspect, the third portion of the chimeric polypeptide assembly compositions comprise a bulking moiety. Exemplary bulking moieties include but are not limited to: extended recombinant polypeptides (XTEN), albumin binding domain, albumin, IgG binding domain, polypeptides consisting of proline, serine, and alanine; fatty acid, ELP biopolymer, Fc domain, polyethylene glycol (PEG), PLGA, and hydoxylethyl starch. In one embodiment, the bulking moiety is an XTEN sequence. Where desired, the XTEN of the third portion comprises an amino acid sequence having at least about 90%, 91%, 92%, 93%, 94%, 95%, 96%, 97%, 98%, 99%, or 100% sequence identity to a sequence selected from the group of sequences set forth in Table 5.

In another aspect, the subject chimeric polypeptide assembly exhibits the ability to bind and link effector cells and target cells, thereby forming an immunological synapse such that the effector cell can mediate its biological effect in a target cell specific manner. For example, a subject chimeric polypeptide assembly possesses the ability to (1) bind specifically to a target cell marker such as a tumor-specific maker, and to (2) bind specifically to an antigen expressed on an effector cell (e.g., an antigen expressed by a T-cell). The concurrent binding of the T cell and the tumor cell mediates killing, damage, and/or lysis of the tumor cell In one embodiment, upon cleavage of the second portion by the one or more mammalian proteases and release of the first portion, the first portion is capable of concurrently binding to a T cell bearing the human CD3 antigen and to a tumor cell bearing the tumor specific marker in an in vitro assay comprising both the T cells and the tumor cells. In an exemplary design characteristic of the inventive compositions, upon cleavage of the second portion RS to release the first portion and the third portion from said chimeric polypeptide assembly, the released first portion has a molecular weight that is at least 2-fold, 3-fold, 4-fold, or 5-fold less than the third portion and has a molecular weight that is at least 20%, or at least 30%, or at least 40%, or at least 50%, or at least 60% less than the intact chimeric polypeptide assembly. In an embodiment, upon cleavage of the second portion RS, the released said first portion from said chimeric polypeptide assembly has increased binding affinity to the effector T cell bearing the CD3 antigen and/or the tumor cell marker compared to the chimeric binding assembly wherein the second portion has not been cleaved. The increased binding affinity of the released first portion to the T cell bearing the human CD3 antigen and/or the tumor cell marker is at least 2-fold, 3-fold, 4-fold, 5-fold, 6-fold, 7-fold, 8-fold, 9-fold, or 10-fold greater compared to the binding affinity of the chimeric polypeptide assembly to the T cell bearing the human CD3 antigen or the tumor cell marker wherein the RS has not been cleaved. In another embodiment, upon cleavage of the second portion RS and the release of said first portion from said chimeric polypeptide assembly, the concurrent binding of the first portion to the T cell and the tumor cell yields cytotoxic activity against the tumor cell in an in vitro assay comprising a population of T cells and tumor cells. In another embodiment, the released first portion of the chimeric polypeptide assembly is capable of effecting a greater amount of cell lysis of the tumor cell compared to an intact chimeric binding assembly in the in vitro assay. For example, the amount of cell lysis effected by the released first portion of the chimeric polypeptide assembly is at least 10-fold greater, or at least 30-fold, or at least 100-fold, or at least 300-fold, or at least 1000-fold greater compared to the intact chimeric binding assembly in the in the in vitro assay. In one embodiment, the cytotoxic activity and/or cell lysis of the tumor cell is mediated by target specific activation of the T cell, wherein the amount of activation of the T cell effected by the released first portion of the chimeric polypeptide assembly is at least 10-fold greater, or at least 30-fold, or at least 100-fold, or at least 300-fold, or at least 1000-fold greater compared to the intact chimeric binding assembly. As the RS of the chimeric binding assembly may be subject to partial cleavage of the RS during an in vitro cytotoxic assay, for purposes of determining the maximum comparative difference in cytotoxicity, the RS of the assembly can be substituted with a non-cleavable peptide and assayed in comparison to a sample of the released first portion. Where desired, the in vitro assay can be assays selected from of cell membrane integrity assay, mixed cell culture assay, FACS based propidium Iodide assay, trypan Blue influx assay, photometric enzyme release assay, radiometric 51Cr release assay, fluorometric Europium release assay, CalceinAM release assay, photometric MTT assay, XTT assay, WST-1 assay, alamar blue assay, radiometric 3H-Thd incorporation assay, clonogenic assay measuring cell division activity, fluorometric rhodamine123 assay measuring mitochondrial transmembrane gradient, apoptosis assay monitored by FACS-based phosphatidylserine exposure, ELISA-based TUNEL test assay, sandwich ELISA, caspase activity assay, cell-based LDH release assay, and cell morphology assay, or any combination thereof, or by the methods described herein in the Examples, below.

In another aspect, the invention provides chimeric polypeptide assembly compositions comprising a first portion wherein said first portion comprises i) a second binding domain with binding specificity to an effector cell antigen; and ii) a first binding domain with binding specificity to a tumor-specific marker or an antigen of a target cell; a second portion wherein said second portion comprises a first release segment (RS) capable of being cleaved by a mammalian protease, a third portion comprising a first bulking moiety wherein said bulking moiety is capable of being released from said first portion by action of said mammalian protease on said second portion, a fourth portion comprising a release segment (RS) that may be the same or may be different from the second portion RS, and a fifth portion comprising a second bulking moiety that may be the same or may be different from the third portion wherein said bulking moiety is capable of being released from said first portion by action of said mammalian protease on said fourth portion. In one embodiment of the foregoing, the second release segment of the chimeric polypeptide assembly composition comprises an amino acid sequence selected from the group consisting of the sequences set forth in Table 4. In another embodiment of the foregoing, the second release segment of the chimeric polypeptide assembly composition comprises an amino acid sequence selected from the group consisting of the sequences LSGRSDNHSPLGLAGS (SEQ ID NO: 1), SPLGLAGSLSGRSDNH (SEQ ID NO: 2), SPLGLS-GRSDNH (SEQ ID NO: 3), LAGRSDNHSPLGLAGS (SEQ ID NO: 4), LSGRSDNHVPLSLKMG (SEQ ID NO: 5), SPLGLAGS (SEQ ID NO: 6), GPLALARG (SEQ ID NO: 7), LSGRSDNH (SEQ ID NO: 8), VPLSLTMG (SEQ ID NO: 9), VPLSLKMG (SEQ ID NO: 10), VPLSLSMG (SEQ ID NO: 11), EPLELVAG (SEQ ID NO: 12), EPLEL-RAG (SEQ ID NO: 13), EPAALMAG (SEQ ID NO: 14), EPASLMAG (SEQ ID NO: 15), RIGSLRTA (SEQ ID NO: 16), RIQFLRTA (SEQ ID NO: 17), EPFHLMAG (SEQ ID NO: 18), VPLSLFMG (SEQ ID NO: 19), EPLELPAG (SEQ ID NO: 20), and EPLELAAG (SEQ ID NO: 21). In another embodiment of the foregoing, the second release segment of the chimeric polypeptide assembly composition comprises an amino acid sequence capable of being cleaved by a protease selected from the group of proteases set forth in Table 3. In another embodiment of the foregoing, the bulking moiety of the fifth portion of the composition is selected from the group consisting of: XTEN; albumin binding domain; albumin; IgG binding domain; a polypeptide of at least 350 amino acid residues consisting of proline, serine, and alanine; fatty acid; and Fc domain. In another embodiment of the foregoing, the bulking moiety of the fifth portion of the composition is XTEN. In another embodiment of the foregoing, the bulking moiety of the composition is an XTEN comprising an amino acid sequence having at least 90%, 91%, 92%, 93%, 94%, 95%, 96%, 97%, 98%, 99%, or 100% sequence identity, when optimally aligned, to a sequence selected from the group of sequences set forth in Table 5. In one embodiment, the invention provides a chimeric polypeptide assembly composition, comprising an amino acid sequence with at least 90%, 91%, 92%, 93%, 94%, 95%, 96%, 97%, 98%, 99%, or 100% sequence identity to the amino acid sequence without the signal peptide, as set forth in Table 10, when optimally aligned. In another embodiment, the invention provides a chimeric polypeptide assembly composition, comprising an amino acid sequence with at least 90%, 91%, 92%, 93%, 94%, 95%, 96%, 97%, 98%, 99%, or 100% sequence identity to the amino acid sequence, as set forth in Table 12, when optimally aligned. In another embodiment, the invention provides a chimeric polypeptide assembly composition, comprising an amino acid sequence with at least 90%, 91%, 92%, 93%, 94%, 95%, 96%, 97%, 98%, 99%, or 100% sequence identity to the amino acid sequence, as set forth in FIG. 36 or FIG. 37. In another embodiment, the invention provides chimeric polypeptide assembly consisting of an amino acid sequence having a polypeptide sequence selected from the group consisting of the sequences set forth in FIG. 36 or FIG. 37.

In an exemplary characteristic of the chimeric polypeptide assembly compositions, the ability to effect cytolysis of the target cells after release of the first portion binding domains (compared to the intact composition) is proportionally greater than the increased binding affinity to the target cell marker of released first portion as compared to that of the intact composition. In one embodiment of this characteristic, the relative cytotoxicity expressed as EC50 integer, compared to the binding affinity expressed as the log of the Kd in an in vitro assay is at least about 2:1, or at least 10:1, or at least 50:1, or at least 100:1, or at least 300:1, or at least 500:1, or at least 1000:1. In another embodiment, the ratio of cytotoxicity (e.g., expressed as the EC50 integer), to the binding affinity (e.g., expressed as the log of the $K_d$) of the released first portion of the chimeric polypeptide assembly in an in vitro assay is at least about 2-fold, at least about 3-fold, at least about 5-fold, at least about 10-fold, at least about 30-fold, at least about 50-fold, or at least about 100-fold greater.

In some embodiments, wherein in a comparison of a) the relative cytotoxicity, which is measured as a ratio between the cytotoxicity of (i) the released first portion to the target tumor cell in an in vitro assay comprising both the T cells and tumor cells bearing the target cell marker and (ii) the cytotoxicity of a composition comprising the corresponding first portion of the chimeric polypeptide assembly and the corresponding third portion of the chimeric polypeptide assembly linked by a non-cleavable peptide of 1 to about 10 amino acids; and b) the relative binding affinity to the effector cell antigen, which is measured as a ratio between the binding affinity of (i) the released first portion to the effector cell antigen and (ii) the binding affinity to the effector cell antigen of a composition comprising the corresponding first portion of the chimeric polypeptide assembly and the corresponding third portion of the chimeric polypeptide assembly linked by a non-cleavable peptide of 1 to about 10 amino acids, where the ratio between the relative cytotoxicity and the relative binding affinity is greater than at least 3:1, 10:1, or greater than at least 30:1, or greater than at least 50:1, or greater than at least 100:1, or greater than at least 300:1, or greater than at least 500:1, or greater than at least 1000:1. In one embodiment of the foregoing, the non-cleavable peptide has the sequence glycine-serine, serine-glycine, or multiple units of either dipeptide and the effector cell antigen is CD3. In one embodiment, wherein in a comparison of a) the relative cytotoxicity, which is measured as a ratio between the cytotoxicity of (i) the released first portion to the target tumor cell in an in vitro assay comprising both the T cells and tumor cells bearing the target cell marker and (ii) the cytotoxicity of a composition comprising the corresponding first portion of the chimeric polypeptide assembly and the corresponding third portion of the chimeric polypeptide assembly linked by a non-cleavable peptide of 1 to about 10 amino acids; and b) the relative binding affinity to the target cell marker, which is measured as a ratio between the binding affinity of (i) the released first portion to the target cell marker and (ii) the binding affinity to the target cell marker of a composition comprising the corresponding first portion of the chimeric polypeptide assembly and the corresponding third portion of the chimeric polypeptide assembly linked by a non-cleavable peptide of 1 to about 10 amino acids, where the ratio between the relative cytotoxicity and the relative binding affinity is greater than at least 3:1, 10:1, or greater than at least 30:1, or greater than at least 50:1, or greater than at least 100:1, or greater than at least 300:1, or greater than at least 500:1, or greater than at least 1000:1. In one embodiment of the foregoing, the non-cleavable peptide has the sequence glycine-serine, serine-glycine, or multiple units of either dipeptide and the effector cell antigen is CD3. In another embodiment, wherein in a comparison of a) the relative cytotoxicity, which is measured as a ratio between the cytotoxicity of (i)

the released first portion to the target tumor cell in an in vitro assay comprising both the T cells and tumor cells bearing the target cell marker and (ii) the cytotoxicity of a composition comprising the corresponding first portion of the chimeric polypeptide assembly and the corresponding third portion of the chimeric polypeptide assembly linked by a non-cleavable peptide of 1 to about 10 amino acids; b) the relative effector cell antigen binding affinity, which is measured as a ratio between the binding affinity of (i) the released first portion to the effector cell antigen and (ii) the binding affinity of a composition comprising the corresponding first portion of the chimeric polypeptide assembly and the corresponding third portion of the chimeric polypeptide assembly linked by a non-cleavable peptide of 1 to about 10 amino acids; and c) the relative binding affinity to the target cell marker, which is measured as a ratio between the binding affinity of (i) the released first portion to the target cell marker and (ii) the binding affinity to the target cell marker of a composition comprising the corresponding first portion of the chimeric polypeptide assembly and the corresponding third portion of the chimeric polypeptide assembly linked by a non-cleavable peptide of 1 to about 10 amino acids, where the ratio between the relative cytotoxicity and the relative effector cell antigen binding affinity multiplied with the relative binding affinity to the target cell marker is greater than at least 3:1, 10:1, or greater than at least 30:1, or greater than at least 50:1, or greater than at least 100:1, or greater than at least 300:1, or greater than at least 500:1, or greater than at least 1000:1. In one embodiment of the foregoing, the non-cleavable peptide has the sequence glycine-serine, serine-glycine, or multiple units of either dipeptide and the effector cell antigen is CD3.

In one embodiment, the invention provides chimeric polypeptide assembly compositions in which the EC50 value of the released first portion of the chimeric polypeptide assembly composition in an in vitro cytotoxicity assay comprising both the T cells and tumor cells bearing the target cell marker is ≤5000 pg/ml, even more preferably ≤1000 pg/ml, even more preferably ≤500 pg/ml, even more preferably ≤350 pg/ml, even more preferably ≤250 pg/ml, even more preferably <100 pg/ml, even more preferably ≤50 pg/ml, even more preferably <10 pg/ml, and most preferably ≤5 pg/ml. In one embodiment, the EC50 value of the released first portion of the chimeric polypeptide assembly composition in the in vitro assay is at least 10-fold, or at least 20-fold, or at least 30-fold, or at least 40-fold, or at least 50-fold, or at least 60-fold, or at least 70-fold, or at least 80-fold, or at least 90-fold, or at least 100-fold, or at least 120-fold less than the EC50 value of the intact chimeric polypeptide assembly composition.

In some cases, the binding affinity of the first binding domain of the released first portion to the tumor specific marker is greater compared to the binding affinity of the second binding domain of the released first portion to the CD3 antigen. In one embodiment, the binding affinity of the first binding domain of the released first portion to the target cell, as measured by $K_d$ constant in the in vitro assay, is at least one order of magnitude greater compared to the binding affinity of the second binding domain to the CD3 antigen. In other embodiments, the binding affinity of the first binding domain of the released first portion to the target cell, as measured by $K_d$ constant in an in vitro binding assay is between $10^{-5}$ to $10^{-9}$ M and the $K_d$ of the second binding domain is between $10^{-5}$ to $10^{-9}$M. The binding affinity can be determined by standard cell-based assays, ELISA, assays described in the Examples, herein, or in other in vitro assays known in the art.

In another aspect, the invention relates to the enhanced properties of the chimeric polypeptide assembly when administered to a subject. It is specifically contemplated that the intact chimeric polypeptide assembly compositions comprising release segments exhibit less cytotoxicity and/or reduced capacity to elicit the production of proinflammatory cytokines compared to the released first portion component. In one embodiment, the invention provides chimeric polypeptide assembly compositions wherein upon or following administration of a composition comprising the chimeric polypeptide assembly to a subject, the second portion of the assembly is cleaved in proximity to a tumor expressing a protease capable of cleaving the RS. Upon cleavage of the second portion by said mammalian protease and release of the first portion from the assembly, the first portion is capable of concurrently binding to a T cell bearing the human CD3 antigen and to a tumor cell bearing the tumor specific marker in the subject. In one embodiment, the concurrent binding of the released first portion to a T cell bearing the CD3 antigen and the tumor cell bearing the tumor cell marker results in the release of T cell-derived effector molecules. In the foregoing, the effector molecule is selected from one or more effector molecules of the group consisting of TNF-α, IFN-γ, interleukin 2, perforin, and granzymes, or other T cell effector molecules known in the art. As a consequence of the concurrent binding of the effector cell and the target cell, an immunological synapse is created, which effects lysis of the target cell by the T cell and the effector molecules.

In another aspect, the invention relates to chimeric polypeptide assembly compositions with increased terminal half-life and other properties imparted by the bulking moiety; e.g., XTEN. In one embodiment, the invention provides chimeric polypeptide assembly compositions wherein the intact composition exhibits a half-life upon or following administration to a subject that is at least 2-fold, 3-fold, 4-fold, 5-fold, 6-fold, 7-fold, 8-fold, 9-fold, or 10-fold greater compared to the half-life of the first portion not linked to said second and third portions upon or following administration to a subject at a comparable dose. In another embodiment, upon or following administration of the chimeric polypeptide assembly to a subject and cleavage of the second portion and release of said first portion and said third portion from said chimeric polypeptide assembly, said first portion has a half-life that is at least 2-fold, 3-fold, 4-fold, 5-fold, 6-fold, 7-fold, 8-fold, 9-fold, or 10-fold less compared to the intact chimeric polypeptide assembly in the subject. In a related embodiment, the plasma Cmax concentration of the released first portion upon or following a single administration of the chimeric polypeptide composition to the subject does not exceed about 0.01 ng/ml, or about 0.1 ng/ml, or about 1 ng/ml, or about 10 ng/ml, or about 100 ng/ml. In another related embodiment, the plasma Cmax concentration of the released first portion upon or following a single administration of the intact chimeric polypeptide composition to the subject is at least 3-fold lower, or at least 10-fold lower, or at least 30-fold lower, or at least 100-fold lower than the plasma Cmax concentration of the intact chimeric polypeptide assembly in the same subject. Pharmacokinetic parameters can be measured using plasma samples from a subject being administered with the subject chimeric polypeptide assembly using methods described herein or conventional methods known in the art. In another embodiment, upon or following administration to a subject, the intact chimeric polypeptide assembly exhibits reduced extravasation from the blood circulatory system in the subject compared to the chimeric polypeptide assembly in which the RS is cleaved, releasing the first portion and the third portion. In the foregoing embodiments of this paragraph, the subject can be mouse, rat, monkey, dog, and human.

In another aspect, the invention relates to pharmaceutical compositions of the chimeric polypeptide assembly. In one embodiment, the invention provides pharmaceutical compositions comprising the chimeric polypeptide assembly of any of the chimeric polypeptide assembly disclosed herein, and one or more pharmaceutically suitable excipients and, optionally, one or more carriers or stabilizers. In another embodiment, the pharmaceutical composition is formulated for intradermal, subcutaneous, intravenous, intra-arterial, intraabdominal, intraperitoneal, intrathecal, or intramuscular administration. In another embodiment, the pharmaceutical composition is in a liquid form. In a related embodiment, the pharmaceutical composition in a liquid form is supplied in a pre-filled syringe for a single injection. In other embodiments, the pharmaceutical composition is formulated as a lyophilized powder to be reconstituted prior to administration.

In another aspect, the invention relates to methods and uses of the chimeric polypeptide assembly or a pharmaceutical composition comprising the chimeric polypeptide assembly. In one embodiment, the invention provides a chimeric polypeptide assembly or a pharmaceutical composition comprising the chimeric polypeptide assembly for the preparation of a medicament for the treatment of a disease in a subject. In a related embodiment, the medicament is used in a disease, wherein the disease is selected from the group consisting of carcinoma, Hodgkin's lymphoma, and non-Hodgkin's lymphoma, diffuse large B cell lymphoma, follicular lymphoma, mantle cell lymphoma, blastoma, breast cancer, ER/PR+ breast cancer, Her2+ breast cancer, triple-negative breast cancer, colon cancer, colon cancer with malignant ascites, mucinous tumors, prostate cancer, head and neck cancer, skin cancer, melanoma, genito-urinary tract cancer, ovarian cancer, ovarian cancer with malignant ascites, peritoneal carcinomatosis, uterine serous carcinoma, endometrial cancer, cervix cancer, colorectal, uterine cancer, mesothelioma in the peritoneum, kidney cancer, Wilm's tumor, lung cancer, small-cell lung cancer, non-small cell lung cancer, gastric cancer, stomach cancer, small intestine cancer, liver cancer, hepatocarcinoma, hepatoblastoma, liposarcoma, pancreatic cancer, gall bladder cancer, cancers of the bile duct, esophageal cancer, salivary gland carcinoma, thyroid cancer, epithelial cancer, arrhenoblastoma, adenocarcinoma, sarcoma, and B-cell derived chronic lymphatic leukemia.

In another aspect, the invention relates to chimeric polypeptide assembly or a pharmaceutical composition comprising the chimeric polypeptide assembly for use in a method of treating a disease in a subject, wherein the method comprises administering the chimeric polypeptide assembly or the pharmaceutical composition to a subject with the disease, including but not limited to cancer. Where desired, the method comprises administering to the subject in need thereof a therapeutically effective dose of a pharmaceutical composition comprising the chimeric polypeptide assembly and one or more excipients. In one embodiment of the method of treatment, the disease is selected from the group consisting of carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome. In another embodiment of the method of treatment, the pharmaceutical composition is administered to the subject as one or more therapeutically effective doses administered twice weekly, once a week, every two weeks, every three weeks, or monthly. In another embodiment of the method of treatment, the pharmaceutical composition is administered to the subject as one or more doses over a period of at least two weeks, or at least one month, or at least two months, or at least three months, or at least four months, or at least five months, or at least six months. In another embodiment of the method of treatment, the dose is administered intradermally, subcutaneously, intravenously, intra-arterially, intra-abdominally, intraperitoneally, intrathecally, or intramuscularly. In another embodiment of the method of treatment, the dose is administered as a bolus dose or by infusion of 5 minutes to 96 hours as tolerated for maximal safety and efficacy. In another embodiment of the method of treatment, the dose is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least 0.3 mg/kg, at least 0.4. mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In another embodiment of the method of treatment, the initial dose is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, and a subsequent dose is selected from the group consisting of at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least 0.3 mg/kg, at least 0.4. mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In another embodiment of the method of treatment, the administration of the therapeutically effective dose of the pharmaceutical composition to the subject results in a plasma concentration of the chimeric polypeptide assembly of at least about 0.1 ng/mL to at least about 2 ng/mL or more in the subject for at least about 3 days, at least about 7 days, at least about 10 days, at least about 14 days, or at least about 21 days.

In another embodiments, the invention provides a pharmaceutical composition for use in a method for the treatment of a disease, the method comprising administering the pharmaceutical composition to a subject with the disease according to a treatment regimen comprising one or more consecutive doses using a therapeutically effective dose. In one embodiment of the pharmaceutical composition for the use in the method for the treatment of a disease, the disease is selected from the group consisting of carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome. In another embodiment of the pharmaceutical composition for the use in the treatment of a disease, the treatment regimen is part of a specified treatment cycle, wherein the specified treatment cycle comprises administration of the pharmaceutical composition twice a week, every week, every 10 days, every two weeks, every three weeks, or every month per each treatment cycle. In one embodiment, the treatment regimen results in the improvement of a clinical parameter or endpoint associated with the disease in the subject, wherein the clinical parameter or endpoint is selected from one or any combination of the group consisting of tumor shrinkage as a complete, partial or incomplete response; time-to-progression, time to treatment failure, biomarker response; progression-free survival; disease free-survival; time to recurrence; time to metastasis; time of overall survival; improvement of quality of life; and improvement of symptoms. In the foregoing embodiments of the method, the subject is selected from the group consisting of mouse, rat, monkey, and human.

In another aspect, the invention relates to kits comprising the pharmaceutical composition. In one embodiment, the invention provides a kit comprising the pharmaceutical composition of any one of embodiments disclosed herein, a container and a label or package insert on or associated with the container. In another embodiment, the invention provides a kit comprising a pre-filled syringe containing the pharmaceutical composition of any one of embodiments disclosed herein, and a label or package insert on or associated with the syringe.

In another aspect, the invention relates to the differential characteristics and effects of the intact versus the cleaved chimeric polypeptide assembly compositions. In one embodiment, the invention provides a chimeric polypeptide assembly of any of the embodiments disclosed herein, wherein the chimeric polypeptide assembly that is intact has at least a 10-fold, or at least 20-fold, or at least 30-fold, or at least 40-fold, or at least 50-fold, or at least 60-fold, or at least 70-fold, or at least 80-fold, or at least 90-fold, or at least 100-fold, or at least 1000-fold lower potential to effect production of a Th1 cytokine from an effector cell compared to the corresponding first portion of the assembly that is not linked to the assembly, when said assembly is in contact with the effector cell and a target cell. In one embodiment, the production of the Th1 cytokine is assayed in an in vitro assay comprising PBMC or CD3+ T cells and target cells having a tumor specific marker antigen selected from the group consisting of alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. In the foregoing embodiment, the Th1 cytokine is selected from the group consisting of IL-2, TNF-alpha, and IFN-gamma. In another embodiment, the production of the Th1 cytokine is assayed using blood or a fluid sample from a subject administered the chimeric polypeptide assembly compared to a subject administered the corresponding first portion not linked to the chimeric polypeptide assembly, with the result that the chimeric polypeptide assembly that is intact has at least a 10-fold, or at least 20-fold, or at least 30-fold, or at least 40-fold, or at least 50-fold, or at least 60-fold, or at least 70-fold, or at least 80-fold, or at least 90-fold, or at least 100-fold, or at least 1000-fold lower potential to effect production of the Th1 cytokine. In the foregoing embodiment, the subject is selected from the group consisting of mouse, rat, monkey, and human.

In other cases, the chimeric polypeptide assembly of any of the embodiments disclosed herein exhibits the characteristic that the chimeric polypeptide assembly that is intact has at least a 10-fold, or at least 20-fold, or at least 30-fold, or at least 40-fold, or at least 50-fold, or at least 60-fold, or at least 70-fold, or at least 80-fold, or at least 90-fold, or at least 100-fold lower potential to extravasate from the circulation when administered to a subject compared to the first portion not linked to the chimeric polypeptide assembly when administered at a comparable dose to a subject.

In another aspect, the invention relates to nucleic acids encoding the subject compositions. In one embodiment, the invention provides an isolated nucleic acid comprising a polynucleotide sequence selected from (a) a polynucleotide encoding the chimeric polypeptide assembly of any one of the embodiments disclosed herein, or (b) the complement of the polynucleotide of (a). In another embodiment, the invention provides an isolated nucleic acid comprising a polynucleotide sequence with at least 90%, 91%, 92%, 93%, 94%, 95%, 96%, 97%, 98%, 99%, or 100% sequence identity to a polynucleotide sequence set forth in Table 10 or Table 14. In another embodiment, the invention provides an expression vector comprising a polynucleotide sequence of the foregoing embodiments and a recombinant regulatory sequence operably linked to the polynucleotide sequence. In another embodiment, the invention provides an isolated host cell, comprising the foregoing expression vector. In one embodiment, the host cell is E. coli.

In another aspect, the invention relates to T cell binding compositions and nucleic acids that encode them. In one embodiment, the invention provides a monomeric fusion protein comprising an amino acid sequence having at least 90%, 91%, 92%, 93%, 94%, 95%, 96%, 97%, 98%, 99%, or 100% sequence identity to an amino acid sequence selected from the group consisting of the amino acid sequences set forth in Table 7, wherein the monomeric fusion protein exhibits binding affinity to a CD3 antigen of a T cell. In another embodiment, the invention provides an isolated nucleic acid comprising a polynucleotide sequence selected from (a) a polynucleotide encoding the fusion protein of the foregoing T cell binding composition, (b) a polynucleotide sequence having at least 90%, 91%, 92%, 93%, 94%, 95%, 96%, 97%, 98%, 99%, or 100% sequence identity to a polynucleotide sequence selected from the group consisting of the polynucleotide sequences set forth in Table 7; or (c) the complement of the polynucleotide of (a) or (b).

In another embodiment, the invention provides a method of use of the nucleic acid encoding the fusion protein of the foregoing T cell binding composition in a method of making a polynucleotide sequence encoding the chimeric polypeptide assembly of any one of the chimeric polypeptide assembly embodiments disclosed herein, the method comprising operably linking a polynucleotide sequence encoding a scFv with binding affinity to a target cell marker disclosed herein or selected from the group of targets set forth in Table 2, in frame to a polynucleotide encoding the fusion protein of the foregoing disclosed T cell binding composition. In another embodiment, the invention provides an expression vector comprising the foregoing polynucleotide sequence and a recombinant regulatory sequence operably linked to the polynucleotide sequence. The invention also provides an isolated host cell, comprising the expression vector, wherein the host cell is E. coli.

In yet another aspect, the invention relates to methods of producing the chimeric polypeptide assembly embodiments disclosed herein. In one embodiment, the invention provides a method of producing a chimeric polypeptide assembly disclosed herein, the method comprising transforming a host cell with an expression vector encoding the chimeric polypeptide assembly, culturing the host cell under conditions permitting the chimeric polypeptide assembly to be expressed in the transformed host cell, and isolating the chimeric polypeptide assembly as a soluble fusion protein. In some embodiments, at least 70%, or at least 80%, or at least 90%, or at least 95%, or at least 97%, or at least 99% of the first and the second binding domains of the expressed fusion protein are correctly folded.

In other cases, the invention provides methods of inducing death of a target cell. The method typically comprises contacting said target cell with a chimeric polypeptide assembly of an embodiment disclosed herein and an effector cell. In an embodiment, the contact results in an effect in the target cell including but not limited to loss of membrane integrity, pyknosis, karyorrhexis, inducement of the intrinsic pathway of apoptosis, inducement of the extrinsic pathway of apoptosis, apoptosis, cell lysis, and cell death.

Cytotoxicity resulting in cell death (e.g., necrosis or apoptosis) can be determined by any suitable method, including, but not limited to, counting cells before and after treatment, or measuring the level of a marker associated with live or dead cells. Degree of cell death may be determined by any suitable method. In some embodiments, degree of cell death is determined with respect to a starting condition. For example, an individual may have a known starting amount of target cells, such as a starting cell mass or tumor of known size or circulating target cells at a known concentration. In another example, one can compare degree of cell death induced by one composition with respect to another (e.g. chimeric polypeptide assembly linked to a bulking moiety and a chimeric polypeptide assembly not linked to a bulking moiety). In such cases, degree of cell death may be expressed as a ratio of surviving cells after treatment to the starting cell population. In some embodiments, degree of cell death may be determined by a suitable cell death assay. In some embodiment, degree of cell death may be determined by measurement of tumor size over time. A variety of cell death assays are available, and may utilize a variety of detection methodologies. Examples of detection methodologies include, without limitation, the use of cell staining, microscopy, flow cytometry, cell sorting, and combinations of these. Further non-limiting examples of cell death assays are described in WO2011131472A1 and US20130052160, which is incorporated herein by reference.

In one embodiment of the foregoing, the method is employed in an in vitro cell-based assay comprising a mixed population of the target cells and the effector cells, and an effective amount of the chimeric polypeptide assembly having binding affinity for antigens of the target cell and the effector cell. In the assay, the target cell expresses a tumor specific marker antigen including but not limited to alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2 and the effector cell is a is T cell wherein the effector cell antigen is CD3. In other embodiments, the method of inducing death of a target cell is employed in a subject having a cancer comprising a population of the target cell, wherein the method comprises administering a therapeutically effective amount of the chimeric polypeptide assembly to the subject. In one embodiment of the foregoing, the method comprises administering the chimeric polypeptide assembly as one or more consecutively administered therapeutically effective doses of a pharmaceutical composition comprising the chimeric polypeptide assembly and one or more excipients. In another embodiment of the foregoing, the method comprises a regimen of determining the amount of a pharmaceutical composition needed to achieve a therapeutic effect in the subject having the cancer and administering the amount as one or more consecutively doses to the subject. In the methods of inducing death of a target cell in a subject, wherein the target cell is a cancer cell, where the cancer can be carcinoma, Hodgkin's lymphoma, and non-Hodgkin's lymphoma, diffuse large B cell lymphoma, follicular lymphoma, mantle cell lymphoma, blastoma, breast cancer, ER/PR+ breast cancer, Her2+ breast cancer, triple-negative breast cancer, colon cancer, colon cancer with malignant ascites, mucinous tumors, prostate cancer, head and neck cancer, skin cancer, melanoma, genito-urinary tract cancer, ovarian cancer, ovarian cancer with malignant ascites, peritoneal carcinomatosis, uterine serous carcinoma, endometrial cancer, cervix cancer, colorectal, uterine cancer, mesothelioma in the peritoneum, kidney cancer, Wilm's tumor, lung cancer, small-cell lung cancer, non-small cell lung cancer, gastric cancer, stomach cancer, small intestine cancer, liver cancer, hepatocarcinoma, hepatoblastoma, liposarcoma, pancreatic cancer, gall bladder cancer, cancers of the bile duct, esophageal cancer, salivary gland carcinoma, thyroid cancer, epithelial cancer, arrhenoblastoma, adenocarcinoma, sarcoma, and B-cell derived chronic lymphatic leukemia. By use of the inventive method in the subject with a cancer, the method results in an improvement of a clinical parameter or endpoint wherein the clinical parameter or endpoint can be overall survival, symptom endpoints, disease-free survival, objective response rate, complete response, duration of response, progression-free survival, time to progression, time-to-treatment failure, tumor measurement, tumor size, tumor response rate, time to metastasis, and biomarker concentration. In other cases, use of the inventive method in the subject with a cancer results in a reduction in the frequency, duration, or severity in diagnostically associated side effects in the subject compared to administration of a comparable dose, in mmoles/kg, to a comparable subject of a composition comprising the first portion and an absence the second portion and third portion of the chimeric polypeptide assembly, wherein the side effects can be one or more of the following: increased plasma levels of IL-2, increased plasma levels of TNF-alpha, increased plasma levels of IFN-gamma, sepsis, febrile neutropenia, neurotoxicity, convulsions, encephalopathy, cytokine release syndrome, speech disturbance, equilibrium disturbance, fever, headache, confusion, hypotension, neutropenia, nausea, impaired consciousness, disorientation, and increased liver enzymes.

In still other cases, the invention provides methods of delivering a therapeutic agent to a tumor cell comprising a tumor specific marker, the method comprising administering to the target cell the chimeric polypeptide assembly of any one of the embodiments disclosed herein, wherein the therapeutic agent is delivered to the target cell via the first binding domain of the first portion specifically binding to the tumor specific marker. In the foregoing, the tumor specific marker is selected from the group consisting of alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. Where desired, the tumor specific marker is selected from the group consisting of Alpha 4 Integrin, Ang2, CEACAM5, CD19, CD20, CD33, CD38, cMET, CTLA4, EpCAM, EphA2, FOLR1, HER1(EGFR), HER2, HER3, HER1(EGFR)/HER3, HER2/3, Mesothelin, MUC1, PD-L1, PSMA, TAG-72, VEGFR1, VEGFR2. In one embodiment of the method, the chimeric polypeptide assembly comprises an amino acid sequence having at least 90%, or at least 91%, or at least 92%, or at least 93%, or at least 94%, or at least 95%, or at least 96%, or at least 97%, or at least 98%, or at least 99%, or at least 100% sequence identity to a polypeptide sequence selected from the group consisting of the sequences of Table 12. In another embodiment of the method, the chimeric polypeptide assembly comprises an amino acid sequence having at least 90%, or at least 91%, or at least 92%, or at least 93%, or at least 94%, or at least 95%, or at least 96%, or at least 97%, or at least 98%, or at least 99%, or at least 100% sequence identity to a polypeptide sequence selected from the group consisting of the sequences set forth in FIG. 36 or FIG. 37. In an embodiment of the foregoing methods, the tumor cell resides in a tumor in a subject, wherein the subject can be mouse, rat, monkey, dog, and human.

In another aspect, the invention relates to physical characteristics of the chimeric polypeptide assembly compositions and resulting properties when administered to a subject. With respect to the chimeric polypeptide assembly embodiments disclosed herein, neither the second portion nor the third portion of the chimeric polypeptide assembly has specific binding affinity for the first portion. For each chimeric polypeptide assembly embodiments disclosed herein, the first portion accounts for less than 50% of the molecular weight of the intact chimeric polypeptide assembly. In another embodiment, the first portion of the chimeric polypeptide assembly embodiments disclosed herein accounts for less than 30%, or less than 40%, or less than 50% of the apparent molecular weight factor of the chimeric polypeptide assembly, when apparent molecular weight factor is assessed by size exclusion chromatography. Further, upon cleavage of the second portion and release of said first portion and said third portion from any of the chimeric polypeptide assembly embodiments disclosed herein, the hydrodynamic radius of the released first portion is less than about 30%, or less than about 40%, or less than about 50% of the hydrodynamic radius of the intact chimeric polypeptide assembly, when hydrodynamic radius is assessed by size exclusion chromatography. In one embodiment, the invention provides a chimeric polypeptide assembly, wherein upon cleavage of the second portion and release of said first portion and said third portion from said chimeric polypeptide assembly, the hydrodynamic radius of the released first portion is less than about 5 nm, or less than about 4 nm, or less than about 3 nm when hydrodynamic radius is determined by size exclusion chromatography. Accordingly, the released first portion has greater ability to penetrate a tumor tissue compared to an intact chimeric polypeptide assembly. In another embodiment, the hydrodynamic radius of an intact chimeric polypeptide assembly disclosed herein is greater than about 8 nm, or greater than about 9 nm, or greater than about 10 nm when hydrodynamic radius is determined by size exclusion chromatography. Accordingly, an intact chimeric polypeptide assembly administered to a subject with a tumor is less able to extravasate from vasculature of normal tissue of the subject compared to the ability to extravasate from vasculature of the tumor.

It is specifically contemplated that the chimeric polypeptide assembly composition embodiments can exhibit one or more or any combination of the properties disclosed herein. It is further specifically contemplated that the methods of treatment can exhibit one or more or any combination of the properties disclosed herein.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments FIG. 1 depicts the various schematic figures used in various drawings, together with descriptions of what they represent.

FIG. 8 shows schematic representations of two configurations of the ProTIA compositions in which the RS and bulking moiety is linked either to the effector cell binding moiety (on the left) or the tumor antigen binding moiety (on the right).

FIG. 9 shows schematic representations of configurations of the ProTIA compositions in which two Release Segments and two bulking moieties are linked to the binding moieties.

FIG. 14 shows the purification of uncleaved AC1278 from fermentation media, as described in Example 2.

FIG. 15 shows the lot release analytics of uncleaved AC1278, as described in Example 2.

FIG. 16 shows the preparation of cleaved ProTIA-A using uncleaved AC1278, as described in Example 2.

FIG. 17 shows the lot release analytics of cleaved AC1278, as described in Example 2.

FIG. 18 shows the purification of uncleaved AC1476 from fermentation media, as described in Example 3.

FIG. 19 shows the lot release analytics of uncleaved AC1476 as described in Example 3.

FIG. 20 shows additional lot release analytics of uncleaved AC1476 as described in Example 3.

FIG. 21 shows the preparation of cleaved ProTIA-A using uncleaved AC1476 as described in Example 3.

FIG. 22 shows the lot release analytics of cleaved AC1476 as described in Example 3.

FIG. 23 shows the additional lot release analytics of cleaved AC1476 as described in Example 3.

FIG. 29 shows schematic representations of the alternate N- to C-terminus configurations of a T-cell binding composition. FIG. 29A shows the configuration of the effector cell binding moiety (ECBM) followed by release site segment (RS) and XTEN while

FIG. 33 depicts results from an experiment to determine the cytokine profile of protease-treated and untreated anti-EpCAM×anti-CD3 ProTIA, as described in Example 12.

FIG. 34 depicts results from an experiment to determine the cytokine profile of protease-treated and untreated anti-EpCAM×anti-CD3 ProTIA, as described in Example 12.

FIG. 35 depicts results from an experiment to determine the cytokine profile of protease-treated and untreated anti-EpCAM×anti-CD3 ProTIA, as described in Example 12.

FIG. 36: The amino acid sequence of the AC1476 aEp-CAM-aCD3 ProTIA. Figure discloses SEQ ID NO: 533.

FIG. 37: The amino acid sequence of the AC1489 aEp-CAM-aCD3 ProTIA. Figure discloses SEQ ID NO: 534.

FIG. 42 depicts results from the experiment to measure activation of CD69 on CD8 and CD4 cells in co-culture of PBMC and SK-OV-3 cells with protease-treated, protease-untreated and protease noncleavable anti-EpCAM×anti-CD3 ProTIA, as described in Example 8. FIG. 42A depicts the activation of CD69 on CD8 cells, while

FIG. 43 depicts results from the experiment to measure activation of both CD69 and CD25 on CD8 and CD4 cells in co-culture of PBMC and SK-OV-3 cells with protease-treated, protease-untreated and protease noncleavable anti-EpCAM×anti-CD3 ProTIA, as described in Example 8. FIG. 43A depicts the activation of both CD69 and CD25 on CD8 cells, while

FIG. 44 depicts results from the experiment to measure activation of CD69 on CD8 and CD4 cells in co-culture of purified CD3+ cells and SK-OV-3 cells with protease-treated, protease-untreated and protease noncleavable anti-EpCAM×anti-CD3 ProTIA, as described in Example 8. FIG. 44A depicts the activation of CD69 on CD8 cells, while

FIG. 45 depicts results from the experiment to measure activation of both CD69 and CD25 on CD8 and CD4 cells in co-culture of purified CD3+ cells and SK-OV-3 cells with protease-treated, protease-untreated and protease noncleavable anti-EpCAM×anti-CD3 ProTIA, as described in Example 8. FIG. 45A depicts the activation of both CD69 and CD25 on CD8 cells, while

FIG. 46 depicts results from the experiment to measure activation of CD69 on CD8 and CD4 cells in co-culture of purified CD3+ cells and OVCAR3 cells with protease-treated, protease-untreated and protease noncleavable anti-EpCAM×anti-CD3 ProTIA, as described in Example 8. FIG. 46A depicts the activation of CD69 on CD8 cells, while

FIG. 47 depicts results from the experiment to measure activation of both CD69 and CD25 on CD8 and CD4 cells in co-culture of purified CD3+ cells and OVCAR3 cells with protease-treated, protease-untreated and protease noncleavable anti-EpCAM×anti-CD3 ProTIA, as described in Example 8. FIG. 47A depicts the activation of both CD69 and CD25 on CD8 cells, while

FIG. 48 depicts results from the experiment to measure activation of CD69 on CD8 and CD4 cells in co-culture of PBMC and OVCAR3 cells with protease-treated, protease-untreated and protease noncleavable anti-EpCAM×anti-CD3 ProTIA, as described in Example 8. FIG. 48A depicts the activation of CD69 on CD8 cells, while

FIG. 49 depicts results from the experiment to measure activation of both CD69 and granzyme B in CD8 and CD4 cells in co-culture of PBMC and OVCAR3 cells with protease-treated, protease-untreated and protease noncleavable anti-EpCAM×anti-CD3 ProTIA, as described in Example 8. FIG. 49A depicts the activation of both CD69 and granzyme B in CD8 cells, while

FIG. 50 depicts results from the experiment to measure release of cytokines IL-2 and IL-4 in co-culture of purified CD3+ cells and SK-OV-3 cells with protease-treated, protease-untreated and protease noncleavable anti-EpCAM×anti-CD3 ProTIA, as described in Example 15. FIG. 50A depicts the concentration of released IL-2, while

FIG. 51 depicts results from the experiment to measure release of cytokines IL-6 and IL-10 in co-culture of purified CD3+ cells and SK-OV-3 cells with protease-treated, protease-untreated and protease noncleavable anti-EpCAM×anti-CD3 ProTIA, as described in Example 15. FIG. 51A depicts the concentration of released IL-6, while

FIG. 52 depicts results from the experiment to measure release of cytokines TNF-alpha and IFN-gamma in co-culture of purified CD3+ cells and SK-OV-3 cells with protease-treated, protease-untreated and protease noncleavable anti-EpCAM×anti-CD3 ProTIA, as described in Example 15. FIG. 52A depicts the concentration of released TNF-alpha, while

DETAILED DESCRIPTION OF THE INVENTION

Figure 2:
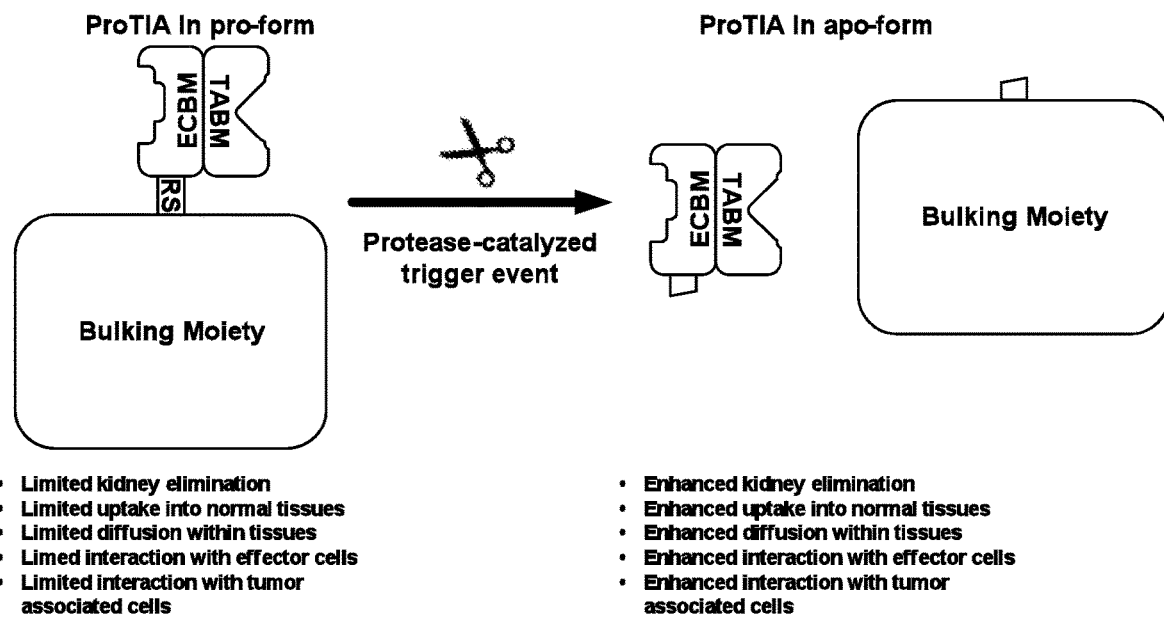
FIG. 2 depicts a ProTIA composition (also described as chimeric polypeptide assembly herein) that is in the uncleaved, "pro" form and in the cleaved state after being acted on by a tumor associated protease. The figure also describes some of the non-limiting properties of both forms of the compositions.

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

In the context of the present application, the following terms have the meanings ascribed to them unless specified otherwise:

As used throughout the specification and claims, the terms "a", "an" and "the" are used in the sense that they mean "at least one", "at least a first", "one or more" or "a plurality" of the referenced components or steps, except in instances wherein an upper limit is thereafter specifically stated. Therefore, a "cleavage sequence", as used herein, means "at least a first cleavage sequence" but includes a plurality of cleavage sequences. The operable limits and parameters of combinations, as with the amounts of any single agent, will be known to those of ordinary skill in the art in light of the present disclosure.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

The term "monomeric" as applied to a polypeptide refers to the state of the polypeptide as being a single continuous amino acid sequence substantially unassociated with one or more additional polypeptide of the same or different sequence. The monomeric state of the polypeptide can be ascertained as a single proteinaceous entity of the same molecular weight by size exclusion chromatography.

As used herein, the term "amino acid" refers to either natural and/or unnatural or synthetic amino acids, including but not limited to both the D or L optical isomers, and amino acid analogs and peptidomimetics. Standard single or three letter codes may be used to designate amino acids.

The term "natural L-amino acid" or "L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water. Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" when applied to a biologically active protein (and not an antibody), is a truncated form of a the biologically active protein that retains at least a portion of the therapeutic and/or biological activity. A "variant," when applied to a biologically active protein is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity compared with the reference biologically active protein. As used herein, the term "biologically active protein variant" includes proteins modified deliberately, as for example, by site directed mutagenesis, synthesis of the encoding gene, insertions, or accidentally through mutations and that retain activity.

The term "sequence variant" means polypeptides that have been modified compared to their native or original sequence by one or more amino acid insertions, deletions, or substitutions. Insertions may be located at either or both termini of the protein, and/or may be positioned within internal regions of the amino acid sequence. A non-limiting example is substitution of an amino acid in an XTEN with a different amino acid. In deletion variants, one or more amino acid residues in a polypeptide as described herein are removed. Deletion variants, therefore, include all fragments of a described polypeptide sequence. In substitution variants, one or more amino acid residues of a polypeptide are removed and replaced with alternative residues. In one aspect, the substitutions are conservative in nature and conservative substitutions of this type are well known in the art.

The term "moiety" means a component of a larger composition or that is intended to be incorporated into a larger composition, such as a proteinaceous portion joined to a larger polypeptide as a contiguous or non-contiguous sequence. A moiety of a larger composition can confer a desired functionality. For example, a bulking moiety may confer the functionality of increasing molecular weight and/or half-life of a resulting larger composition with which the bulking moiety is associated.

The term "release segment" or "RS" refers to a cleavage sequence in compositions that can be recognized and cleaved by one or more proteases, effecting release of one or more portions or moieties from the composition. As used herein, "mammalian protease" means a protease that normally exists in the body fluids, cells, tissues, and may be found in higher levels in certain target tissues or cells, e.g., in diseased tissues (e.g., tumor) of a mammal. RS sequences can be engineered to be cleaved by various mammalian proteases or multiple mammalian proteases that are present in or proximal to target tissues in a subject or are introduced in an in vitro assay. Other equivalent proteases (endogenous or exogenous) that are capable of recognizing a defined cleavage site can be utilized. It is specifically contemplated that the RS sequence can be adjusted and tailored to the protease utilized and can incorporate linker amino acids to join to adjacent polypeptides The term "within", when referring to a first polypeptide being linked to a second polypeptide, encompasses linking or fusion of an additional component that connects the N-terminus of the first or second polypeptide to the C-terminus of the second or first polypeptide, respectively, as well as insertion of the first polypeptide into the sequence of the second polypeptide. For example, when an RS component is linked "within" a chimeric polypeptide assembly, the RS may be linked to the N-terminus, the C-terminus, or may be inserted between any two amino acids of an XTEN polypeptide.

"Activity" as applied to form(s) of a composition provided herein, refers to an action or effect, including but not limited to receptor binding, antagonist activity, agonist activity, a cellular or physiologic response, cell lysis, cell death, or an effect generally known in the art for the effector component of the composition, whether measured by an in vitro, ex vivo or in vivo assay or a clinical effect.

"Effector cell", as used herein, includes any eukaryotic cells capable of conferring an effect on a target cell. For example, an effect cell can induce loss of membrane integrity, pyknosis, karyorrhexis, apoptosis, lysis, and/or death of a target cell. In another example, an effector cell can induce division, growth, differentiation of a target cell or otherwise altering signal transduction of a target cell. Non-limiting examples of effector cell include plasma cell, T cell, CD4 cell, CD8 cell, B cell, cytokine induced killer cell (CIK cell), master cell, dendritic cell, regulatory T cell (RegT cell), helper T cell, myeloid cell, macrophage, and NK cell.

An "effector cell antigen" refers to molecules expressed by an effector cell, including without limitation cell surface molecules such as proteins, glycoproteins or lipoproteins. Exemplary effector cell antigens include proteins of the CD3 complex or the T cell receptor (TCR), CD4, CD8, CD25, CD38, CD69, CD45RO, CD57, CD95, CD107, and CD154, as well as effector molecules such as cytokines in association with, bound to, expressed within, or expressed and released by, an effector cell. An effector cell antigen can serve as the binding counterpart of a binding domain of the subject chimeric polypeptide assembly. Non-limiting examples of effector cell antigens to which the subject composition may bind include antigens on the cell surface such as CD3, CD4, CD8, CD25, CD38, CD69, CD45RO, CD57, CD95, CD107, and CD154 as well as Th1 cytokines selected from IL2, IL10, IL12, IFNγ, and TNFα.

As used herein, the term "ELISA" refers to an enzyme-linked immunosorbent assay as described herein or as otherwise known in the art.

A "host cell" includes an individual cell or cell culture which can be or has been a recipient for the subject vectors into which exogenous nucleic acid has been introduced, such as those described herein. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated", when used to describe the various polypeptides disclosed herein, means polypeptide that has been identified and separated and/or recovered from a component of its natural environment or from a more complex mixture (such as during protein purification). Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated nucleic acid" is a nucleic acid molecule that is identified and separated from at least one contaminant nucleic acid molecule with which it is ordinarily associated in the natural source of the polypeptide-encoding nucleic acid. For example, an isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extrachromosomal location different from that of natural cells.

A "chimeric" protein or polypeptide contains at least one fusion polypeptide comprising at least one region in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Fused," and "fusion" are used interchangeably herein, and refers to the joining together of two or more peptide or polypeptide sequences by recombinant means. A "fusion protein" or "chimeric protein" comprises a first amino acid sequence linked to a second amino acid sequence with which it is not naturally linked in nature.

"XTENylated" is used to denote a peptide or polypeptide that has been modified by the linking or fusion of one or more XTEN polypeptides (described, below) to the peptide or polypeptide, whether by recombinant or chemical cross-linking means.

"Operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. For example, a promoter or enhancer is operably linked to a coding sequence for a polypeptide if it affects the transcription of the polypeptide sequence. Thus, the resulting recombinant fusion protein is a single protein containing two or more segments that correspond to polypeptides encoded by the original ORFs (which segments are not normally so joined in nature).

"Crosslinking," "conjugating," "link," "linking" and "joined to" are used interchangeably herein, and refer to the covalent joining of two different molecules by a chemical reaction. The crosslinking can occur in one or more chemical reactions, as known in the art.

The term "conjugation partner" as used herein, refers to the individual components that can be linked or are linked in a conjugation reaction.

The term "conjugate" (used as a noun) is intended to refer to the heterogeneous molecule formed as a result of covalent linking of conjugation partners one to another, e.g., a binding domain covalently linked to a release segment.

"Cross-linker" and "cross-linking agent" are used interchangeably and in their broadest context to mean a chemical entity used to covalently join two or more entities. For example, a cross-linker joins two, three, four or more peptides, or joins a peptide to an XTEN. It will be understood by one of skill in the art that a cross-linker can refer to the covalently-bound reaction product remaining after the crosslinking of the reactants. The cross-linker can also comprise one or more reactants which have not yet reacted but which are capable to react with another entity.

In the context of polypeptides, a "linear sequence" or a "sequence" is an order of amino acids in a polypeptide in an amino to carboxyl terminus (N- to C-terminus) direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to nucleotides of any length, encompassing a singular nucleic acid as well as plural nucleic acids, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of recombination steps which may include cloning, restriction and/or ligation steps, and other procedures that result in expression of a recombinant protein in a host cell.

The terms "gene" and "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

As used herein, a "coding region" or "coding sequence" is a portion of polynucleotide which consists of codons translatable into amino acids. Although a "stop codon" (TAG, TGA, or TAA) is typically not translated into an amino acid, it may be considered to be part of a coding region, but any flanking sequences, for example promoters, ribosome binding sites, transcriptional terminators, introns, and the like, are not part of a coding region. The boundaries of a coding region are typically determined by a start codon at the 5' terminus, encoding the amino terminus of the resultant polypeptide, and a translation stop codon at the 3' terminus, encoding the carboxyl terminus of the resulting polypeptide. Two or more coding regions of the present invention can be present in a single polynucleotide construct, e.g., on a single vector, or in separate polynucleotide constructs, e.g., on separate (different) vectors. It follows, then, that a single vector can contain just a single coding region, or comprise two or more coding regions, e.g., a single vector can separately encode a binding domain-A and a binding domain-B as described below. In addition, a vector, polynucleotide, or nucleic acid of the invention can encode heterologous coding regions, either fused or unfused to a nucleic acid encoding a binding domain of the invention. Heterologous coding regions include without limitation specialized elements or motifs, such as a secretory signal peptide or a heterologous functional domain.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

"Homology" or "homologous" refers to sequence similarity or interchangeability between two or more polynucleotide sequences or between two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity compared to those sequences. Polypeptides that are homologous preferably have sequence identities that are at least 70%, preferably at least 80%, even more preferably at least 90%, even more preferably at least 95-99% identical when optimally aligned over sequences of comparable length.

"Ligation" as applied to polynucleic acids refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al., "Molecular Cloning: A Laboratory Manual," 3$^{rd}$ edition, Cold Spring Harbor Laboratory Press, 2001. Typically, blocking reagents are used to block non-specific hybridization. Such blocking reagents include, for instance, sheared and denatured salmon sperm DNA at about 100-200 µg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity," percentage of sequence identity," and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured. The percentage of sequence identity is calculated by comparing two optimally aligned sequences over the window of comparison, determining the number of matched positions (at which identical residues occur in both polypeptide sequences), dividing the number of matched positions by the total number of positions in the window of comparison (i.e., the window size), and multiplying the result by 100 to yield the percentage of sequence identity. When sequences of different length are to be compared, the shortest sequence defines the length of the window of comparison. Conservative substitutions are not considered when calculating sequence identity.

"Percent (%) sequence identity," with respect to the polypeptide sequences identified herein, is defined as the percentage of amino acid residues in a query sequence that are identical with the amino acid residues of a second, reference polypeptide sequence of comparable length or a portion thereof, after aligning the sequences and introducing gaps, if necessary, to achieve the maximum percent sequence identity, and not considering any conservative substitutions as part of the sequence identity, thereby resulting in optimal alignment. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve optimal alignment over the full length of the sequences being compared. Percent identity may be measured over the length of an entire defined polypeptide sequence, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

"Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

The term "expression" as used herein refers to a process by which a polynucleotide produces a gene product, for example, an RNA or a polypeptide. It includes without limitation transcription of the polynucleotide into messenger RNA (mRNA), transfer RNA (tRNA), small hairpin RNA (shRNA), small interfering RNA (siRNA) or any other RNA product, and the translation of an mRNA into a polypeptide. Expression produces a "gene product." As used herein, a gene product can be either a nucleic acid, e.g., a messenger RNA produced by transcription of a gene, or a polypeptide which is translated from a transcript. Gene products described herein further include nucleic acids with post transcriptional modifications, e.g., polyadenylation or splicing, or polypeptides with post translational modifications, e.g., methylation, glycosylation, the addition of lipids, association with other protein subunits, or proteolytic cleavage.

A "vector" or "expression vector" are used interchangeably and refers to a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, dog, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The terms "$t_{1/2}$", "half-life", "terminal half-life", "elimination half-life" and "circulating half-life" are used interchangeably herein and, as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. When a clearance curve of a given polypeptide is constructed as a function of time, the curve is usually biphasic with a rapid α-phase and longer β-phase. The typical β-phase half-life of a human antibody in humans is 21 days. Half-life can be measured using timed samples from anybody fluid, but is most typically measured in plasma samples.

The term "molecular weight" generally refers to the sum of atomic weights of the constituent atoms in a molecule. Molecular weight can be determined theoretically by summing the atomic masses of the constituent atoms in a molecule. When applied in the context of a polypeptide, the molecular weight is calculated by adding, based on amino acid composition, the molecular weight of each type of amino acid in the composition or by estimation from comparison to molecular weight standards in an SDS electrophoresis gel. The calculated molecular weight of a molecule can differ from the "apparent molecular weight" of a molecule, which generally refers to the molecular weight of a molecule as determined by one or more analytical techniques. "Apparent molecular weight factor" and "apparent molecular weight" are related terms and when used in the context of a polypeptide, the terms refer to a measure of the relative increase or decrease in apparent molecular weight exhibited by a particular amino acid or polypeptide sequence. The apparent molecular weight can be determined, for example, using size exclusion chromatography (SEC) or similar methods by comparing to globular protein standards, as measured in "apparent kD" units. The apparent molecular weight factor is the ratio between the apparent molecular weight and the "molecular weight"; the latter is calculated by adding, based on amino acid composition as described above, or by estimation from comparison to molecular weight standards in an SDS electrophoresis gel. The determination of apparent molecular weight and apparent molecular weight factor is described in U.S. Pat. No. 8,673,860.

The terms "hydrodynamic radius" or "Stokes radius" is the effective radius ($R_h$ in nm) of a molecule in a solution measured by assuming that it is a body moving through the solution and resisted by the solution's viscosity. In the embodiments of the invention, the hydrodynamic radius measurements of the XTEN polypeptides correlate with the "apparent molecular weight factor" which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Diffusion coefficient" means the magnitude of the molar flux through a surface per unit concentration gradient out-of-plane. In dilute species transport, the flux due to diffusion is given by Fick's first law, which only depends on a single property of the solute's interaction with the solvent: the diffusion coefficient.

"Physiological conditions" refers to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers are listed in Sambrook et al. (2001). Physiologically relevant temperature ranges from about 25° C. to about 38° C., and preferably from about 35° C. to about 37° C.

The term "binding domain", as used herein, is specifically intended to include the categories of antibodies or antibody fragments that have specific binding affinity for a target antigen or ligand such as cell-surface receptors or antigens or glycoproteins, oligonucleotides, enzymatic substrates, antigenic determinants, or binding sites that may be present in or on the surface of a target tissue or cell.

The term "antibody" is used herein in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity. The full-length antibodies may be for example monoclonal, recombinant, chimeric, deimmunized, humanized and human antibodies.

The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being known in the art or described herein.

An "antibody fragment" refers to a molecule other than an intact antibody that comprises a portion of an intact antibody and that binds the antigen to which the intact antibody binds. Examples of antibody fragments include but are not limited to Fv, Fab, Fab', Fab'-SH, F(ab')2, diabodies, linear antibodies, a single domain antibody, a single domain camelid antibody, single-chain antibody molecules (scFv), and multispecific antibodies formed from antibody fragments.

"scFv" or "single chain fragment variable" are used interchangeably herein to refer to an antibody fragment format comprising variable regions of heavy ("VH") and light ("VL") chains or two copies of a VH or VL chain, which are joined together by a short flexible peptide linker. The scFv is not actually a fragment of an antibody, but is a fusion protein of the variable regions of the heavy (VH) and light chains (VL) of immunoglobulins, and can be easily expressed in functional form in E. coli.

The terms "antigen", "target antigen" and "immunogen" are used interchangeably herein to refer to the structure or binding determinant that an antibody, antibody fragment or an antibody fragment-based molecule binds to or has specificity against.

The term "epitope" refers to the particular site on an antigen molecule to which an antibody, antibody fragment, or binding domain binds. An epitope is a ligand of an antibody or antibody fragment.

As used herein, "CD3" or "cluster of differentiation 3" means the T cell surface antigen CD3 complex, which includes in individual form or independently combined form all known CD3 subunits, for example CD3 epsilon, CD3 delta, CD3 gamma, CD3 zeta, CD3 alpha and CD3 beta. The extracellular domains of CD3 epsilon, gamma and delta contain an immunoglobulin-like domain, so are therefore considered part of the immunoglobulin superfamily.

The terms "specific binding" or "specifically bind" or "binding specificity" are used interchangeably herein to refer to the high degree of binding affinity of a binding domain to its corresponding target. Typically, specific binding as measured by one or more of the assays disclosed herein would have a dissociation constant or $K_d$ of less than about $10^{-6}$ M.

"Affinity" refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant ($K_d$). As used herein "a greater binding affinity" means a lower $K_d$ value; e.g., $1 \times 10^{-9}$ M is a greater binding affinity than $1 \times 10^{-8}$ M.

"Inhibition constant", or "Ki", are used interchangeably and mean the dissociation constant of the enzyme-inhibitor complex, or the reciprocal of the binding affinity of the inhibitor to the enzyme.

"Dissociation constant", or "$K_d$", are used interchangeably and mean the affinity between a ligand "L" and a protein "P"; i.e. how tightly a ligand binds to a particular protein. It can be calculated using the formula $K_d=[L][P]/[LP]$, where [P], [L] and [LP] represent molar concentrations of the protein, ligand and complex, respectively. The term "$k_{on}$", as used herein, is intended to refer to the on rate constant for association of an antibody to the antigen to form the antibody/antigen complex as is known in the art. The term "$k_{off}$", as used herein, is intended to refer to the off rate constant for dissociation of an antibody from the antibody/antigen complex as is known in the art.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

A "target cell marker" refers to a molecule expressed by a target cell including but not limited to cell-surface receptors, antigens, glycoproteins, oligonucleotides, enzymatic substrates, antigenic determinants, or binding sites that may be present in the on the surface of a target tissue or cell that may serve as ligands for antibodies.

A "target tissue" refers to a tissue that is the cause of or is part of a disease condition such as, but not limited to cancer or inflammatory conditions. Sources of diseased target tissue include a body organ, a tumor, a cancerous cell or population of cancerous cells or cells that form a matrix or are found in association with a population of cancerous cells, bone, skin, cells that produce cytokines or factors contributing to a disease condition.

A "defined medium" refers to a medium comprising nutritional and hormonal requirements necessary for the survival and/or growth of the cells in culture such that the components of the medium are known. Traditionally, the defined medium has been formulated by the addition of nutritional and growth factors necessary for growth and/or survival. Typically, the defined medium provides at least one component from one or more of the following categories: a) all essential amino acids, and usually the basic set of twenty amino acids plus cysteine; b) an energy source, usually in the form of a carbohydrate such as glucose; c) vitamins and/or other organic compounds required at low concentrations; d) free fatty acids; and e) trace elements, where trace elements are defined as inorganic compounds or naturally occurring elements that are typically required at very low concentrations, usually in the micromolar range. The defined medium may also optionally be supplemented with one or more components from any of the following categories: a) one or more mitogenic agents; b) salts and buffers as, for example, calcium, magnesium, and phosphate; c) nucleosides and bases such as, for example, adenosine and thymidine, hypoxanthine; and d) protein and tissue hydrolysates.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

As used herein, "treatment" or "treating," or "palliating" or "ameliorating" is used interchangeably herein. These terms refer to an approach for obtaining beneficial or desired results including but not limited to a therapeutic benefit and/or a prophylactic benefit. By therapeutic benefit is meant eradication or amelioration of the underlying disorder being treated. Also, a therapeutic benefit is achieved with the eradication or amelioration of one or more of the physiological symptoms or improvement in one or more clinical parameters associated with the underlying disorder such that an improvement is observed in the subject, notwithstanding that the subject may still be afflicted with the underlying disorder. For prophylactic benefit, the compositions may be administered to a subject at risk of developing a particular disease, or to a subject reporting one or more of the physiological symptoms of a disease, even though a diagnosis of this disease may not have been made.

A "therapeutic effect" or "therapeutic benefit," as used herein, refers to a physiologic effect, including but not limited to the mitigation, amelioration, or prevention of disease or an improvement in one or more clinical parameters associated with the underlying disorder in humans or other animals, or to otherwise enhance physical or mental wellbeing of humans or animals, resulting from administration of a polypeptide of the invention other than the ability to induce the production of an antibody against an antigenic epitope possessed by the biologically active protein. For prophylactic benefit, the compositions may be administered to a subject at risk of developing a particular disease, a recurrence of a former disease, condition or symptom of the disease, or to a subject reporting one or more of the physiological symptoms of a disease, even though a diagnosis of this disease may not have been made.

The terms "therapeutically effective amount" and "therapeutically effective dose", as used herein, refer to an amount of a drug or a biologically active protein, either alone or as a part of a polypeptide composition, that is capable of having any detectable, beneficial effect on any symptom, aspect, measured parameter or characteristics of a disease state or condition when administered in one or repeated doses to a subject. Such effect need not be absolute to be beneficial. Determination of a therapeutically effective amount is well within the capability of those skilled in the art, especially in light of the detailed disclosure provided herein.

The term "therapeutically effective and non-toxic dose" as used herein refers to a tolerable dose of the compositions as defined herein that is high enough to cause depletion of tumor or cancer cells, tumor elimination, tumor shrinkage or stabilization of disease without or essentially without major toxic effects in the subject. Such therapeutically effective and non-toxic doses may be determined by dose escalation studies described in the art and should be below the dose inducing severe adverse side effects.

The term "dose regimen", as used herein, refers to a schedule for consecutively administered multiple doses (i.e., at least two or more) of a composition, wherein the doses are given in therapeutically effective amounts to result in sustained beneficial effect on any symptom, aspect, measured parameter, endpoint, or characteristic of a disease state or condition.

The terms "cancer" and "cancerous" refer to or describe the physiological condition in mammals that is typically characterized by unregulated cell growth/proliferation. Examples of cancer include, but are not limited to, carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome.

"Tumor-specific marker" as used herein, refers to an antigen that is found on or in a cancer cell that may be, but is not necessarily, found in higher numbers in or on the cancer cell relative to normal cells or tissues.

"Target cell" refers to a cell that has the ligand of an antibody or antibody fragment of the subject compositions and is associated with or causes a disease or pathologic condition, including cancer cells, tumor cells, and inflammatory cells. The ligand of a target cell is referred to herein as a "target cell marker" or "target cell antigen" and includes, but is not limited to, cell surface receptors or antigens, cytokines, MHC proteins, and cytosol proteins or peptides that are exogenously presented. As used herein, "target cell" would not include an effector cell.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," $3^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," $11^{th}$ Edition, McGraw-Hill, 2005; and Freshney, R. I., "Culture of Animal Cells: A Manual of Basic Technique," $4^{th}$ edition, John Wiley & Sons, Somerset, N J, 2000, the contents of which are incorporated in their entirety herein by reference.

Host cells can be cultured in a variety of media. Commercially available media such as Ham's F10 (Sigma), Minimal Essential Medium (MEM, Sigma), RPMI-1640 (Sigma), and Dulbecco's Modified Eagle's Medium (DMEM, Sigma) are suitable for culturing eukaryotic cells. In addition, animal cells can be grown in a defined medium that lacks serum but is supplemented with hormones, growth factors or any other factors necessary for the survival and/or growth of a particular cell type. Whereas a defined medium supporting cell survival maintains the viability, morphology, capacity to metabolize and potentially, capacity of the cell to differentiate, a defined medium promoting cell growth provides all chemicals necessary for cell proliferation or multiplication. The general parameters governing mammalian cell survival and growth in vitro are well established in the art. Physicochemical parameters which may be controlled in different cell culture systems are, e.g., pH, $PO_2$, temperature, and osmolarity. The nutritional requirements of cells are usually provided in standard media formulations developed to provide an optimal environment. Nutrients can be divided into several categories: amino acids and their derivatives, carbohydrates, sugars, fatty acids, complex lipids, nucleic acid derivatives and vitamins. Apart from nutrients for maintaining cell metabolism, most cells also require one or more hormones from at least one of the following groups: steroids, prostaglandins, growth factors, pituitary hormones, and peptide hormones to proliferate in serum-free media (Sato, G. H., et al. in "Growth of Cells in Hormonally Defined Media", Cold Spring Harbor Press, N.Y., 1982). In addition to hormones, cells may require transport proteins such as transferrin (plasma iron transport protein), ceruloplasmin (a copper transport protein), and high-density lipoprotein (a lipid carrier) for survival and growth in vitro. The set of optimal hormones or transport proteins will vary for each cell type. Most of these hormones or transport proteins have been added exogenously or, in a rare case, a mutant cell line has been found which does not require a particular factor. Those skilled in the art will know of other factors required for maintaining a cell culture without undue experimentation.

Growth media for growth of prokaryotic host cells include nutrient broths (liquid nutrient medium) or LB medium (Luria Bertani). Suitable media include defined and undefined media. In general, media contains a carbon source such as glucose needed for bacterial growth, water, and salts. Media may also include a source of amino acids and nitrogen, for example beef or yeast extract (in an undefined medium) or known quantities of amino acids (in a defined medium). In some embodiments, the growth medium is LB broth, for example LB Miller broth or LB Lennox broth. LB broth comprises peptone (enzymatic digestion product of casein), yeast extract and sodium chloride. In some embodiments, a selective medium is used which comprises an antibiotic. In this medium, only the desired cells possessing resistance to the antibiotic will grow.

II). Chimeric Polypeptide Assembly Compositions

The present invention relates, in part, to chimeric polypeptide assembly compositions (also referred to as "Pro-TIA") useful in the treatment, amelioration, or prevention of diseases including but not limited to cancers, autoimmune, or inflammatory disorders.

In a first aspect, the present disclosure provides a chimeric polypeptide assembly typically comprising a first portion, a second portion, and a third portion, wherein: said first portion comprises (i) a first binding domain with binding specificity to a target cell marker; and (ii) a second binding domain with binding specificity to an effector cell antigen; said second portion comprises a peptidyl release segment (RS) capable of being cleaved by one or more mammalian proteases; and said third portion comprises a bulking moiety; wherein said bulking moiety is capable of being released from said first portion by action of said mammalian protease on said second portion. Without being bound by theory, an exemplary polypeptide assembly of the present disclosure exhibits one or more of the following features: 1) the assembly comprises at least two binding domains with the capability to concurrently bind an effector cell and a target cell; 2) the assembly comprises a bulking moiety that i) shields the binding domains and reduces binding affinity for the target antigens when the composition is intact by way of, e.g., steric hindrance, ii) provides enhanced half-life of the composition when administered to a subject, and/or iii) reduces extravasation of the composition out of the vasculature in normal tissues and organs compared to diseased tissues (e.g., tumors), resulting in an increased safety profile compared to bispecific cytotoxic antibody therapeutics currently being used or evaluated in clinical trials; and 3) the assembly is capable of being cleaved by one or more mammalian proteases when in the proximity of diseased tissues, such as a tumor or inflammatory tissue, thereby releasing the binding domains of the first portion such that the binding domains can bind to the target cell marker and the effector cell antigen with a higher affinity as compared to the state when the binding domains are not cleaved from the assembly. The subject assembly can advantageously act as a "prodrug" in that the therapeutic portion (e.g., the first portion capable of bringing the target cell and effector cell together) is released at the site of a disease tissue, where the protease is preferentially expressed as compared to normal tissues. The subject assembly addresses several profound drawbacks of existing bispecific antibodies, including BiTE®. The subject assembly typically retains the known therapeutic benefits of tumor shrinkage effected by bispecific antibodies such as BiTE® while mitigating the side effects inherent in the conventional bispecific antibodies. In an embodiment, the invention provides chimeric polypeptide assembly compositions wherein the first portions comprises two binding domains in a single chain format wherein the first binding domain has binding specificity to a tumor-specific marker or an antigen of a target cell and the second binding domain has binding specificity to an effector cell antigen such as a receptor on or a ligand within the effector cell, such that the composition is bispecific.

In some embodiments, the design of the subject compositions is such that the action of the protease cleaves the release segment (RS) of the subject compositions, releasing the binding domains and the bulking moiety from the composition. Upon release from the composition, the first binding domain with binding specificity to a tumor-specific marker or an antigen of a target cell and the second binding domain with binding specificity to an effector cell antigen is capable of concurrently binding to, with greater binding affinity than the intact composition, and linking together the effector cell to the target cell, forming an immunological synapse with the result that, at very low effector to target (E:T) ratios, the target cell is acted upon by effector molecules released by the effector cell into the immunological synapse between the cells, resulting in damage, including, but not limited to perforin-mediated lysis, granzyme B-induced cell death and/or apoptosis of the target cell. In some embodiments, the released first portion of the subject composition compositions is designed with binding specificities such that it has the capability to concurrently bind effector cell cytotoxic T lymphocytes and preselected surface antigens on tumor cells in a subject, thereby effecting an immunological synapse and a selective, directed, and localized effect of released cytokines and effector molecules against the target tumor, with the result that tumor cells are damaged or destroyed, resulting in antitumor activity and therapeutic benefit to a subject. In other embodiments, the effector cell bound by the released first portion is a cell selected from the group consisting of plasma cell, B cell, cytokine induced killer cell (CIK cell), master cell, dendritic cell, regulatory T cell (RegT cell), helper T cell, myeloid cell, and NK cell.

In another aspect, the invention provides chimeric polypeptide assembly compositions comprising a first portion, a second portion, a third portion, a fourth portion, and a fifth portion, wherein the first portion comprises a first and a second binding domain (described more fully below), the second portion comprises a release segment (RS), the third portion comprises a bulking moiety (described more fully below), the fourth portion comprises a release segment (RS) that may be the same or may be different from the second portion RS, and the fifth portion comprises a bulking moiety that may be the same or may be different from the third portion bulking moiety; the composition being essentially in a prodrug form until acted upon by a protease.

The compositions address the long-felt need to provide bispecific therapeutics that have more selectivity, greater half-life, and result in less toxicity and fewer side effects once they are cleaved by proteases found in associated with the target tissues or tissues rendered unhealthy by a disease, such that the subject compositions have improved therapeutic index compared to bispecific antibody compositions known in the art. Such compositions are useful in the treatment of certain diseases, including, but not limited to cancer.

1. Binding Domains

It is an object of the invention to provide chimeric polypeptide assembly compositions comprising a first portion comprising at least a first binding domain with binding specificity to a target cell marker (e.g., a tumor-specific marker) and a second binding domain with binding specificity to an effector cell antigen. In some embodiments, the binding domains are linked as a single chain exhibiting bispecific binding specificity to a target cell marker and an effector cell antigen.

In another aspect, it is an object of the invention to provide cleavable chimeric polypeptide assembly compositions designed with configurations wherein the first portion binding domains are linked to the bulking moiety by a short peptide release segment comprising a cleavage sequence. In this exemplary configuration, the binding domains are shielded by the proximal bulking moiety component(s) in order to reduce or eliminate non-specific interactions and binding with non-diseased tissues or cells that are not the intended targets of the compositions, thereby reducing undesirable toxicity or side effects. In addition, the shielding bulking moiety is released at a target site (e.g., a disease tissue) upon cleavage of the release segment by a protease (described more fully below) that is preferentially expressed at the disease tissue. The released first portion then regains its ability to more freely or more avidly bind to the respective ligands, including a target cell marker and an effector cell marker. Not wishing to be bound by any particular theory, the subject chimeric polypeptide assembly confers manifold advantages as a therapeutic in terms of reduced frequency of administration, increased duration of therapeutic effect, and reduced severity in diagnostically associated side effects in the subject compared to the side effects upon or following administration of a comparable dose, in mmoles/kg, to a composition having only the first portion bispecific binding domains. Non-limiting examples of side effects that are avoided or reduced by use of the subject compositions include undesired increases in plasma levels of IL-2, TNF-alpha, IFN-gamma, liver enzymes, and/or incidences of sepsis, febrile neutropenia, neurotoxicity, convulsions, encephalopathy, cytokine release syndrome, speech disturbance, equilibrium disturbance, fever, headache, confusion, hypotension, neutropenia, nausea, impaired consciousness, and disorientation, The invention contemplates use of single chain binding domains for use in the subject compositions, such as but not limited to Fv, Fab, Fab', Fab'-SH, F(ab')2, linear antibodies, single domain antibody, single domain camelid antibody, single-chain antibody molecules (scFv), and diabodies capable of binding ligands or receptors associated with effector cells and antigens of diseased tissues or cells that are cancers, tumors, or other malignant tissues. In other embodiments, the first and the second binding domains of the first portion of the chimeric polypeptide assembly compositions can be non-antibody scaffolds such as anticalins, adnectins, fynomers, affilins, affibodies, centyrins, DARPins. In other embodiments the binding domain for the tumor cell target is a variable domain of a T cell receptor that has been engineered to bind MHC that is loaded with a peptide fragment of a protein that is overexpressed by tumor cells. The compositions of the instant invention are designed with considerations of the location of the target tissue protease as well as the presence of the same protease in healthy tissues not intended to be targeted, as well as the presence of the target ligand in healthy tissue but a greater presence of the ligand in unhealthy target tissue, in order to provide a wide therapeutic window. A "therapeutic window" refers to the largest difference between the minimal effective dose and the maximal tolerated dose for a given therapeutic composition. To help achieve a wide therapeutic window, the binding domains of the first portion of the compositions are shielded by the proximity of the bulking moiety (e.g., XTEN) such that the binding affinity of the intact composition for one or both of the ligands is reduced compared to the composition that has been cleaved by a mammalian protease, thereby releasing the first portion from the shielding effects of the bulking moiety.

With respect to single chain binding domains, as is well established, Fv is the minimum antibody fragment which contains a complete antigen recognition and binding site; consisting of a dimer of one heavy (VH) and one light chain variable domain (VL) in noncovalent association. Within each VH and VL chain are three complementarity determining regions (CDRs) that interact to define an antigen binding site on the surface of the VH-VL dimer; the six CDRs of a binding domain confer antigen binding specificity to the antibody or single chain binding domain. In some cases, scFv are created in which each has 3, 4, or 5 CHRs within each binding domain. Framework sequences flanking the CDRs have a tertiary structure that is essentially conserved in native immunoglobulins across species, and the framework residues (FR) serve to hold the CDRs in their appropriate orientation. The constant domains are not required for binding function, but may aid in stabilizing VH-VL interaction. The domain of the binding site of the polypeptide of the invention can be a pair of VH-VL, VH—VH or VL-VL domains either of the same or of different immunoglobulins, however it is generally preferred to make single chain binding domains using the respective VH and VL chains from the parental antibody. The order of VH and VL domains within the polypeptide chain is not limiting for the present invention; the order of domains given may be reversed usually without any loss of function, but it is understood that the VH and VL domains are arranged so that the antigen binding site can properly fold. Thus, the single chain binding domains of the bispecific scFv embodiments of the subject compositions can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below.

The arrangement of the binding domains in an exemplary bispecific single chain antibody disclosed herein may therefore be one in which the first binding domain is located C-terminally to the second binding domain. The arrangement of the V chains may be VH (target cell surface antigen)-VL(target cell surface antigen)-VL(effector cell antigen)-VH(effector cell antigen), VH(target cell surface antigen)-VL(target cell surface antigen)-VH(effector cell antigen)-VL(effector cell antigen), VL(target cell surface antigen)-VH(target cell surface antigen)-VL(effector cell antigen)-VH(effector cell antigen) or VL(target cell surface antigen)-VH(target cell surface antigen)-VH(effector cell antigen)-VL(effector cell antigen). For an arrangement, in which the second binding domain is located N-terminally to the first binding domain, the following orders are possible: VH (effector cell antigen)-VL(effector cell antigen)-VL(target cell surface antigen)-VH(target cell surface antigen), VH(effector cell antigen)-VL(effector cell antigen)-VH(target cell surface antigen)-VL(target cell surface antigen), VL(effector cell antigen)-VH(effector cell antigen)-VL(target cell surface antigen)-VH(target cell surface antigen) or VL(effector cell antigen)-VH(effector cell antigen)-VH(target cell surface antigen)-VL(target cell surface antigen). As used herein, "N-terminally to" or "C-terminally to" and grammatical variants thereof denote relative location within the primary amino acid sequence rather than placement at the absolute N- or C-terminus of the bispecific single chain antibody. Hence, as a non-limiting example, a first binding domain which is "located C-terminally to the second binding domain" denotes that the first binding is located on the carboxyl side of the second binding domain within the bispecific single chain antibody, and does not exclude the possibility that an additional sequence, for example a His-tag, or another compound such as a radioisotope, is located at the C-terminus of the bispecific single chain antibody.

In one embodiment, the chimeric polypeptide assembly compositions comprise a first portion comprising a first binding domain and a second binding domain wherein each of said binding domains is an scFv and wherein each scFv comprises one VL and one VH. In another embodiment, the chimeric polypeptide assembly compositions comprise a first portion comprising a first binding domain and a second binding domain wherein said binding domains are in a diabody configuration and wherein each domain comprises one VL domain and one VH. In the foregoing embodiments, the first domain has binding specificity to a tumor-specific marker or an antigen of a target cell and the second binding domain has binding specificity to an effector cell antigen. In one embodiment of the foregoing, the effector cell antigen is expressed on or within an effector cell. In one embodiment, the effector cell antigen is expressed on a T cell, such as a CD4+, CD8+, or natural killer (NK) cell. In another embodiment, the effector cell antigen is expressed on a B cell, master cell, dendritic cell, or myeloid cell. In one embodiment, the effector cell antigen is CD3, the cluster of differentiation 3 antigen of a cytotoxic T cell. In some embodiments of the foregoing, the first binding domain exhibits binding specificity to a tumor-specific marker associated with a tumor cell. In one embodiment, the binding domain has binding affinity to a tumor-specific marker wherein the tumor cell can include without limitation cells fromstroma cell tumor, fibroblast tumor, myofibroblast tumor, glial cell tumor, epithelial cell tumor, fat cell tumor, immune cell tumor, vascular cell tumor, and smooth muscle cell tumor. In one embodiment, the tumor-specific marker or an antigen of a target cell is selected from the group consisting of alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. In one embodiment, the first binding domain that exhibits binding affinity to CD70 is its natural ligand, CD27 rather than an antibody fragment. In another embodiment, the first binding domain that exhibits binding affinity to B7-H6 is its natural ligand Nkp30 rather than an antibody fragment.

It is envisaged that the scFv embodiments of the subject compositions of the invention comprise a first binding domain and a second binding domain wherein the VL and VH domains are derived from monoclonal antibodies with binding specificity to the tumor-specific marker or an antigen of a target cell and effector cell antigens, respectively. In other cases, the first and second binding domains each comprise six CDRs derived from monoclonal antibodies with binding specificity to the a target cell marker, such as a tumor-specific marker and effector cell antigens, respectively. In other embodiments, the first and second binding domains of the first portion of the subject compositions can have 3, 4, or 5 CHRs within each binding domain. In other embodiments, the embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of said regions is derived from a monoclonal antibody capable of binding the tumor-specific marker or an antigen of a target cell, and effector cell antigens, respectively. In one embodiment, the invention provides a chimeric polypeptide assembly composition wherein the second binding domain comprises VH and VL regions derived from a monoclonal antibody capable of binding human CD3. In another embodiment, the invention provides a chimeric polypeptide assembly composition, wherein the scFv second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-CD3 antibody selected from Table 1. In another aspect, the second domain embodiments of the invention comprise a CDR-H1 region, a CDR-H2 region, a CDR-H3 region, a CDR-L1 region, a CDR-L2 region, and a CDR-H3 region, wherein each of said regions is derived from a monoclonal antibody selected from the group of antibodies set forth in Table 1. In the foregoing embodiments, the VH and/or VL domains can be configured as scFv, diabodies, a single domain antibody, or a single domain camelid antibody.

In other embodiments, the second domains of the subject compositions are derived from an anti-CD3 antibody selected from the group of antibodies set forth in Table 1. In one embodiment of the foregoing, the second domain of the subject composition comprises the paired VL and the VH region sequences of the anti-CD3 antibody selected from the group of antibodies set forth in Table 1. In another embodiment, the invention provides a chimeric polypeptide assembly composition, wherein the second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the huUCHT1 anti-CD3 antibody of Table 1. In the foregoing embodiments, the VH and/or VL domains can be configured as scFv, a portion of a diabody, a single domain antibody, or a single domain camelid antibody.

In other embodiments, the scFv of the first domain of the composition are derived from an anti-tumor cell antibody selected from the group of antibodies set forth in Table 2. In another embodiment, the invention provides a chimeric polypeptide assembly composition, wherein the first binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-tumor cell antibody selected from Table 2. In one embodiment of the foregoing, the first domain of the recited compositions comprises the paired VL and the VH region sequences of an anti-tumor cell antibody disclosed herein. In the foregoing embodiments, the VH and/or VL domains can be configured as scFv, a portion of a diabody, a single domain antibody, or a single domain camelid antibody.

In another embodiment, the first portion of the chimeric polypeptide assembly compositions has a sequence with at least about 90%, or 91%, or 92%, or 93%, or 94%, or 95%, or 96%, or 97%, or 98%, or 99% identity to a sequence selected from the group consisting of the sequences of Table 13.

In another embodiment, the chimeric polypeptide assembly compositions comprise a first portion comprising a first binding domain and a second binding domain wherein said binding domains are in a diabody configuration and each of said binding domains comprises one VL domain and one VH domain. In one embodiment, the diabody embodiments of the invention comprise a first binding domain and a second binding domain wherein the VL and VH domains are derived from monoclonal antibodies with binding specificity to a tumor-specific marker or an antigen of a target cell, and the effector cell antigen, respectively. In another embodiment, the diabody embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of said regions is derived from a monoclonal antibody capable of binding the tumor-specific marker or target cell antigen, and the effector cell antigen, respectively. It is envisaged that the diabody embodiments of the invention comprise a first binding domain and a second binding domain wherein the VL and VH domains are derived from monoclonal antibodies with binding specificity to the tumor-specific marker or target cell antigen, and the effector cell antigen, respectively. In another aspect, the diabody embodiments of the invention comprise a first binding domain and a second binding domain wherein each comprises a CDR-H1 region, a CDR-H2 region, a CDR-H3 region, a CDR-L1 region, a CDR-L2 region, and a CDR-H3 region, wherein each of said regions is derived from a monoclonal antibody capable of binding the tumor-specific marker or target cell antigen, and the effector cell antigen, respectively. In one embodiment, the invention provides a chimeric polypeptide assembly composition wherein the diabody second binding domain comprises the paired VH and VL regions derived from a monoclonal antibody capable of binding human CD3. In another embodiment, the invention provides a chimeric polypeptide assembly composition, wherein the diabody second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-CD3 antibody selected from Table 1. In another embodiment, the invention provides a chimeric polypeptide assembly composition, wherein the diabody second binding domain comprises VH and VL regions wherein each VH and VL regions exhibit at least about 90%, or 91%, or 92%, or 93%, or 94%, or 95%, or 96%, or 97%, or 98%, or 99% identity to or is identical to the VL and a VH sequence of the huUCHT1 antibody selected of Table 1. In other embodiments, the diabody second domain of the composition is derived from an anti-CD3 antibody described herein. In another embodiment, the invention provides a chimeric polypeptide assembly composition, wherein the diabody first binding domain comprises VH and VL regions wherein each VH and VL regions exhibit at least about 90%, or 91%, or 92%, or 93%, or 94%, or 95%, or 96%, or 97%, or 98%, or 99% identity to or is identical to VL and VH sequences of an anti-tumor cell antibody selected from Table 2. In other embodiments, the diabody first domain of the composition is derived from an anti-tumor cell antibody described herein.

Therapeutic monoclonal antibodies from which VL and VH and CDR domains can be derived for the subject compositions are known in the art. Such therapeutic antibodies include, but are not limited to, rituximab, IDEC/Genentech/Roche (see for example U.S. Pat. No. 5,736,137), a chimeric anti-CD20 antibody used in the treatment of many lymphomas, leukemias, and some autoimmune disorders; ofatumumab, an anti-CD20 antibody approved for use for chronic lymphocytic leukemia, and under development for follicular non-Hodgkin's lymphoma, diffuse large B cell lymphoma, rheumatoid arthritis and relapsing remitting multiple sclerosis, being developed by GlaxoSmithKline; lucatumumab (HCD122), an anti-CD40 antibody developed by Novartis for Non-Hodgkin's or Hodgkin's Lymphoma (see, for example, U.S. Pat. No. 6,899,879), AME-133, an antibody developed by Applied Molecular Evolution which binds to cells expressing CD20 to treat non-Hodgkin's lymphoma, veltuzumab (hA20), an antibody developed by Immunomedics, Inc. which binds to cells expressing CD20 to treat immune thrombocytopenic purpura, HumaLYM developed by Intracel for the treatment of low-grade B-cell lymphoma, and ocrelizumab, developed by Genentech which is an anti-CD20 monoclonal antibody for treatment of rheumatoid arthritis (see for example U.S. Patent Application 20090155257), trastuzumab (see for example U.S. Pat. No. 5,677,171), a humanized anti-Her2/neu antibody approved to treat breast cancer developed by Genentech; pertuzumab, an anti-HER2 dimerization inhibitor antibody developed by Genentech in treatment of in prostate, breast, and ovarian cancers; (see for example U.S. Pat. No. 4,753,894); cetuximab, an anti-EGFR antibody used to treat epidermal growth factor receptor (EGFR)-expressing, KRAS wild-type metastatic colorectal cancer and head and neck cancer, developed by Imclone and BMS (see U.S. Pat. No. 4,943,533; PCT WO 96/40210); panitumumab, a fully human monoclonal antibody specific to the epidermal growth factor receptor (also known as EGF receptor, EGFR, ErbB-1 and HER1, currently marketed by Amgen for treatment of metastatic colorectal cancer (see U.S. Pat. No. 6,235,883); zalutumumab, a fully human IgG1 monoclonal antibody developed by Genmab that is directed towards the epidermal growth factor receptor (EGFR) for the treatment of squamous cell carcinoma of the head and neck (see for example U.S. Pat. No. 7,247,301); nimotuzumab, a chimeric antibody to EGFR developed by Biocon, YM Biosciences, Cuba, and Oncosciences, Europe) in the treatment of squamous cell carcinomas of the head and neck, nasopharyngeal cancer and glioma (see for example U.S. Pat. Nos. 5,891,996; 6,506,883); alemtuzumab, a humanized monoclonal antibody to CD52 marketed by Bayer Schering Pharma for the treatment of chronic lymphocytic leukemia (CLL), cutaneous T-cell lymphoma (CTCL) and T-cell lymphoma; muromonab-CD3, an anti-CD3 antibody developed by Ortho Biotech/Johnson & Johnson used as an immunosuppressant biologic given to reduce acute rejection in patients with organ transplants; ibritumomab tiuxetan, an anti-CD20 monoclonal antibody developed by IDEC/Schering AG as treatment for some forms of B cell non-Hodgkin's lymphoma; gemtuzumab ozogamicin, an anti-CD33 (p67 protein) antibody linked to a cytotoxic chelator tiuxetan, to which a radioactive isotope is attached, developed by Celltech/Wyeth used to treat acute myelogenous leukemia; ABX-CBL, an anti-CD147 antibody developed by Abgenix; ABX-IL8, an anti-IL8 antibody developed by Abgenix, ABX-MA1, an anti-MUC18 antibody developed by Abgenix, Pemtumomab (R1549, 90Y-muHMFG1), an anti-MUC1 in development by Antisoma, Therex (R1550), an anti-MUC1 antibody developed by Antisoma, AngioMab (AS1405), developed by Antisoma, HuBC-1, developed by Antisoma, Thioplatin (AS1407) developed by Antisoma, ANTEGREN (natalizumab), an anti-alpha-4-beta-1 (VLA4) and alpha-4-beta-7 antibody developed by Biogen, VLA-1 mAb, an anti-VLA-1 integrin antibody developed by Biogen, LTBR mAb, an anti-lymphotoxin beta receptor (LTBR) antibody developed by Biogen, CAT-152, an anti-TGF-β2 antibody developed by Cambridge Antibody Technology, J695, an anti-IL-12 antibody developed by Cambridge Antibody Technology and Abbott, CAT-192, an anti-TGFβ1 antibody developed by Cambridge Antibody Technology and Genzyme, CAT-213, an anti-Eotaxinl antibody developed by Cambridge Antibody Technology, LYMPHOSTAT-B, an anti-Blys antibody developed by Cambridge Antibody Technology and Human Genome Sciences Inc., TRAIL-R1mAb, an anti-TRAIL-R1 antibody developed by Cambridge Antibody Technology and Human Genome Sciences, Inc.; HERCEPTIN, an anti-HER receptor family antibody developed by Genentech; Anti-Tissue Factor (ATF), an anti-Tissue Factor antibody developed by Genentech; XOLAIR (Omalizumab), an anti-IgE antibody developed by Genentech, MLN-02 Antibody (formerly LDP-02), developed by Genentech and Millennium Pharmaceuticals; HUMAX CD4®, an anti-CD4 antibody developed by Genmab; tocilizuma, and anti-IL6R antibody developed by Chugai; HUMAX-IL15, an anti-IL15 antibody developed by Genmab and Amgen, HUMAX-Inflam, developed by Genmab and Medarex; HUMAX-Cancer, an anti-Heparanase I antibody developed by Genmab and Medarex and Oxford GlycoSciences; HUMAX-Lymphoma, developed by Genmab and Amgen, HUMAX-TAC, developed by Genmab; IDEC-131, an anti-CD40L antibody developed by IDEC Pharmaceuticals; IDEC-151 (Cleneliximab), an anti-CD4 antibody developed by IDEC Pharmaceuticals; IDEC-114, an anti-CD80 antibody developed by IDEC Pharmaceuticals; IDEC-152, an anti-CD23 developed by IDEC Pharmaceuticals; an anti-KDR antibody developed by Imclone, DC101, an anti-flk-1 antibody developed by Imclone; anti-VE cadherin antibodies developed by Imclone; CEA-CIDE (labetuzumab), an anti-carcinoembryonic antigen (CEA) antibody developed by Immunomedics; Yervoy (ipilimumab), an anti-CTLA4 antibody developed by Bristol-Myers Squibb in the treatment of melanoma; Lumphocide® (Epratuzumab), an anti-CD22 antibody developed by Immunomedics, AFP-Cide, developed by Immunomedics; MyelomaCide, developed by Immunomedics; LkoCide, developed by Immunomedics; ProstaCide, developed by Immunomedics; MDX-010, an anti-CTLA4 antibody developed by Medarex; MDX-060, an anti-CD30 antibody developed by Medarex; MDX-070 developed by Medarex; MDX-018 developed by Medarex; OSIDEM (IDM-1), an anti-HER2 antibody developed by Medarex and Immuno-Designed Molecules; HUMAX®-CD4, an anti-CD4 antibody developed by Medarex and Genmab; HuMax-IL15, an anti-IL15 antibody developed by Medarex and Genmab; anti-intercellular adhesion molecule-1 (ICAM-1) (CD54) antibodies developed by Morph® Sys, MOR201; tremelimumab, an anti-CTLA-4 antibody developed by Pfizer; visilizumab, an anti-CD3 antibody developed by Protein Design Labs; Anti-a 5β1 Integrin, developed by Protein Design Labs; anti-IL-12, developed by Protein Design Labs; ING-1, an anti-Ep-CAM antibody developed by Xoma; and MLN01, an anti-Beta2 integrin antibody developed by Xoma; all of the above-cited antibody references in this paragraph are expressly incorporated herein by reference. The sequences for the above antibodies can be obtained from publicly available databases, patents, or literature references. In addition, non-limiting examples of monoclonal antibodies and VH and VL sequences from anti-CD3 antibodies are presented in Table 1 and non-limiting examples of monoclonal antibodies and VH and VL sequences to cancer, tumor, or target cell markers are presented in Table 2.

TABLE 1

Anti-CD3 Monoclonal Antibodies and Sequences

| Clone Name | Antibody Name | Target | VH Sequence | SEQ ID NO: | VL Sequence | SEQ ID NO: |
|---|---|---|---|---|---|---|
| huOKT3 | | CD3 | QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSS | 22 | DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR | 32 |
| huUCHT1 | | CD3 | EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSS | 23 | DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIK | 33 |
| hu12F6 | | CD3 | QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS | 24 | DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR | 34 |
| mOKT3 | | CD3 | QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS | 25 | QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR | 35 |
| MT103 | blinatumomab | CD3 | DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS | 26 | DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK | 36 |
| MT110 | solitomab | CD3 | DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS | 27 | DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK | 37 |
| CD3.7 | | CD3 | EVQLVESGGGLVQPGGSLKLSCAASGFTFNKYAMNWVRQAPGKGLEWVARIRSKYNNYATYYADSVKDRFTISRDDSKNTAYLQMNNLKT | 28 | QTVVTQEPSLTVSPGGTVTLTCGSSTGAVTSGYYPNWVQQKPGQAPRGLIGGTKFLAPGTPARFSGSLLGGKAALTLSGVQPEDEAEYYC | 38 |

TABLE 1-continued

Anti-CD3 Monoclonal Antibodies and Sequences

| Clone Name | Antibody Name | Target | VH Sequence | SEQ ID NO: | VL Sequence | SEQ ID NO: |
|---|---|---|---|---|---|---|
| | | | EDTAVYYCVRHGNFG NSYISYWAYWGQGTL VTVSS | | ALWYSNRWVFGGGTK LTVL | |
| CD3.8 | | CD3 | EVQLVESGGGLVQPG GSLRLSCAASGFTFN TYAMNWVRQAPGKGL EWVGRIRSKYNNYAT YYADSVKGRFTISRD DSKNTLYLQMNSLRA EDTAVYYCVRHGNFG NSYVSWFAYWGQGTL VTVSS | 29 | QAVVTQEPSLTVSPG GTVTLTCGSSTGAVT TSNYANWVQQKPGQA PRGLIGGTNKRAPGV PARFSGSLLGGKAAL TLSGAQPEDEAEYYC ALWYSNLWVFGGGTK LTVL | 39 |
| CD3.9 | | CD3 | EVQLLESGGGLVQPG GSLKLSCAASGFTFN TYAMNWVRQAPGKGL EWVARIRSKYNNYAT YYADSVKDRFTISRD DSKNTAYLQMNNLKT EDTAVYYCVRHGNFG NSYVSWFAYWGQGTL VTVSS | 30 | ELVVTQEPSLTVSPG GTVTLTCRSSTGAVT TSNYANWVQQKPGQA PRGLIGGTNKRAPGT PARFSGSLLGGKAAL TLSGVQPEDEAEYYC ALWYSNLWVFGGGTK LTVL | 40 |
| CD3.10 | | CD3 | EVKLLESGGGLVQPK GSLKLSCAASGFTFN TYAMNWVRQAPGKGL EWVARIRSKYNNYAT YYADSVKDRFTISRD DSQSILYLQMNNLKT EDTAMYYCVRHGNFG NSYVSWFAYWGQGTL VTVSS | 31 | QAVVTQESALTTSPG ETVTLTCRSSTGAVT TSNYANWVQEKPDHL FTGLIGGTNKRAPGV PARFSGSLIGDKAAL TITGAQTEDEAIYFC ALWYSNLWVFGGGTK LTVL | 41 |

*underlined sequences, if present, are CDRs within the VL and VH

TABLE 2

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| Tysabri ™ | natalizumab | Alpha 4 Integrin | QVQLVQSGAEVKKPG ASVKVSCKASGFNIK DTYIHWVRQAPGQRL EWMGRIDPANGYTKY DPKFQGRVTITADTS ASTAYMELSSLRSED TAVYYCAREGYYGNY GVYAMDYWGQGTLVT VSS | 42 | DIQMTQSPSSLSASV GDRVTITCKTSQDIN KYMAWYQQTPGKAPR LLIHYTSALQPGIPS RFSGSGSGRDYTFTI SSLQPEDIATYYCLQ YDNLWTFGQGTKVEI K | 141 |
| REGN910 | nesvacumab | Ang2 | EVQLVESGGGLVQPG GSLRLSCAASGFTFS SYDIHWVRQATGKGL EWVSAIGPAGDTYYP GSVKGRFTISRENAK NSLYLQMNSLRAGDT AVYYCARGLITFGGL IAPFDYWGQGTLVTV SS | 43 | EIVLTQSPGTLSLSP GERATLSCRASQSVS STYLAWYQQKPGQAP RLLIYGASSRATGIP DRFSGSGSGTDFTLT ISRLEPEDFAVYYCQ HYDNSQTFGQGTKVE IK | 142 |
| hMFE23 | | CEA | QVKLEQSGAEVVKPG ASVKLSCKASGFNIK DSYMHWLRQGPGKRL EWIGWIDPENGDTEY APKFQGKATFTTDTS ANTAYLGLSSLRPED TAVYYCNEGTPTGPY YFDYWGQGTLVTVSS | 44 | ENVLTQSPSSMSASV GDRVNIACSASSSVS YMHWFQQKPGKSPKL WIYSTSNLASGVPSR FSGSGSGTDYSLTIS SMQPEDAATYYCQQR SSYPLTFGGGTKLEI K | 143 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| M5A (humanized T84.66) | | CEA | EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSS | 45 | DIQLTQSPSSLSASVGDRVTITCRAGESVDIFGVGFLHWYQQKPGKAPKLLIYRASNLESGVPSRFSGSGSRTDFTLTISSLQPEDFATYCQQTNEDPYTFGQGTKVEIK | 144 |
| M5B (humanized T84.66) | | CEA | EVQLVESGGGLVQPGGSLRLSCAASGFNIKDTYMHWVRQAPGKGLEWVARIDPANGNSKYVPKFQGRATISADTSKNTAYLQMNSLRAEDTAVYYCAPFGYYVSDYAMAYWGQGTLVTVSS | 46 | DIQLTQSPSSLSASVGDRVTITCRAGESVDIFGVGFLHWYQQKPGKAPKLLIYRASNLESGVPSRFSGSGSRTDFTLTISSLQPEDFATYCQQTNEDPYTFGQGTKVEIK | 144 |
| CEA-Cide | Labetuzumab (MN-14) | CEACAM5 | EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSS | 47 | DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIK | 145 |
| CEA-Scan | arcitumomab | CEACAM5 | EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS | 48 | QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKR | 146 |
| MT110 | | CEACAM5 | EVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS | 49 | QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL | 147 |
| MT103 | blinatumomab | CD19 | QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS | 50 | DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK | 148 |
| Arzerra | ofatumumab | CD20 | EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS | 51 | EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK | 149 |
| Bexxar ™ | tositumomab | CD20 | QAYLQQSGAELVRPGASVKMSCKASGYTFTSYNMHWVKQTPRQGLEWIGAIYPGNGDTSY | 52 | QIVLSQSPAILSASPGEKVTMTCRASSSVSYMHWYQQKPGSSPKWIYAPSNLASGVPAR | 150 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| | | | NQKFKGKATLTVDKS SSTAYMQLSSLTSED SAVYFCARVVYYSNS YWYFDVWGTGTTVTV SG | | FSGSGSGTSYSLTIS RVEAEDAATYYCQQW SFNPPTFGAGTKLEL K | |
| GAZYVA | Obinutuzumab | CD20 | QVQLVQSGAEVKKPG SSVKVSCKASGYAFS YSWINWVRQAPGQGL EWMGRIFPGDGTDY NGKFKGRVTITADKS TSTAYMELSSLRSED TAVYYCARNVFDGYW LVYWGQGTLVTVSS | 53 | DIVMTQTPLSLPVTP GEPASISCRSSKSLL HSNGITYLYWYLQKP GQSPQLLIYQMSNLV SGVPDRFSGSGSGTD FTLKISRVEAEDVGV YYCAQNLELPYTFGG GTKVEIK | 151 |
| | Ocrelizumab/ 2H7 v16 | CD20 | EVQLVESGGGLVQPG GSLRLSCAASGYTFT SYNMHWVRQAPGKGL EWVGAIYPGNGDTSY NQKFKGRFTISVDKS KNTLYLQMNSLRAED TAVYYCARVVYYSNS YWYFDVWGQGTLVTV SS | 54 | DIQMTQSPSSLSASV GDRVTITCRASSSVS YMHWYQQKPGKAPK LIYAPSNLASGVPSR FSGSGSGTDFTLTIS SLQPEDFATYYCQQW SFNPPTFGQGTKVEI K | 152 |
| Rituxan ™ | rituximab | CD20 | QVQLQQPGAELVKPG ASVKMSCKASGYTFT SYNMHWVKQTPGRGL EWIGAIYPGNGDTSY NQKFKGKATLTADKS SSTAYMQLSSLTSED SAVYYCARSTYYGGD WYFNVWGAGTTVTVS A | 55 | QIVLSQSPAILSASP GEKVTMTCRASSSVS YIHWFQQKPGSSPKP WIYATSNLASGVPVR FSGSGSGTSYSLTIS RVEAEDAATYYCQQW TSNPPTFGGGTKLEI K | 153 |
| Zevalin ™ | ibritumomab tieuxetan | CD20 | QAYLQQSGAELVRPG ASVKMSCKASGYTFT SYNMHWVKQTPRQGL EWIGAIYPGNGDTSY NQKFKGKATLTVDKS SSTAYMQLSSLTSED SAVYFCARVVYYSNS YWYFDVWGTGTTVTV SA | 56 | QIVLSQSPAILSASP GEKVTMTCRASSSVS YMHWYQQKPGSSPKP WIYAPSNLASGVPAR FSGSGSGTSYSLTIS RVEAEDAATYYCQQW SFNPPTFGAGTKLEL K | 150 |
| Mylotarg | Gemtuzumab (hP67.6) | CD33 | QLVQSGAEVKKPGSS VKVSCKASGYTITDS NIHWVRQAPGQSLEW IGYIYPYNGGTDYNQ KFKNRATLTVDNPTN TAYMELSSLRSEDTD FYYCVNGNPWLAYWG QGTLVTVSS | 57 | DIQLTQSPSTLSASV GDRVTITCRASESLD NYGIRFLTWFQQKPG KAPKLLMYAASNQGS GVPSRFSGSGSGTEF TLTISSLQPDDFATY YCQQTKEVPWSFGQG TKVEVK | 154 |
| Daratumumab | | CD38 | EVQLLESGGGLVQPG GSLRLSCAVSGFTFN SFAMSWVRQAPGKGL EWVSAISGSGGGTYY ADSVKGRFTISRDNS KNTLYLQMNSLRAED TAVYFCAKDKILWFG EPVFDYWGQGTLVTV SS | 58 | EIVLTQSPATLSLSP GERATLSCRASQSVS SYLAWYQQKPGQAPR LLIYDASNRATGIPA RFSGSGSGTDFTLTI SSLEPEDFAVYYCQQ RSNWPPTFGQGTKVE IK | 155 |
| | 1F6 | CD70 | QIQLVQSGPEVKKPG ETVKISCKASGYTFT NYGMNWVQAPGKGL KWMGWINTYTGEPTY ADAFKGRFAFSLETS ASTAYLQINNLKNED TATYFCARDYGDYGM DYWGQGTSVTVSS | 59 | DIVLTQSPASLAVSL GQRATISCRASKSVS TSGYSFMHWYQQKPG QPPKLLIYLASNLES GVPARFSGSGSGTDF TLNIHPVEEEDAATY YCQHSREVPWTFGGG TKLEIK | 156 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| | 2F2 | CD70 | QVQLQQSGTELMTPGASVTMSCKTSGYTFSTYWIEWVKQRPGHGLEWIGEILGPSGYTDYNEKFKAKATFTADTSSNTAYMQLSSLASEDSAVYYCARWDRLYAMDYWGGGTSVTVSS | 60 | DIVLTQSPASLTVSLGQKTTISCRASKSVSTSGYSFMHWYQLKPGQSPKLLIYLASDLPSGVPARFSGSGSGTDFTLKIHPVEEEDAATYYCQHSREIPYTFGGGTKLEIT | 157 |
| | 2H5 | CD70 | QVQLVESGGGVVQPGRSLRLSCAASGFTFSSYIMHWVRQAPGKGLEWVAVISYDGRNKYYADSVKGRFTISRDNSKNTLYLQMNSLRAEDTAVYYCARDTDGYDFDYWGQGTLVTVSS | 61 | EIVLTQSPATLSLSPGERATLSCRASQSVSSYLAWYQQKPGQAPRLLIYDASNRATGIPARFSGSGSGTDFTLTISSLEPEDFAVYYCQQRTNWPLTFGGGTKVEIK | 158 |
| | 10B4 | CD70 | QIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSS | 62 | AIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIK | 159 |
| | 8B5 | CD70 | QVQLVESGGGVVQPGRSLRLSCATSGFTFSDYGMHWVRQAPGKGLEWVAVIWYDGSNKYYADSVKGRFTISRDNSKKTLSLQMNSLRAEDTAVYYCARDSIMVRGDYWGQGTLVTVSS | 63 | DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK | 160 |
| | 18E7 | CD70 | QVQLVESGGGVVQPGRSLRLSCAASGFTFSDHGMHWVRQAPGKGLEWVAVIWYDGSNKYYADSVKGRFTISRDNSKNTLYLQMNSLRAEDTAVYYCARDSIMVRGDYWGQGTLVTVSS | 64 | DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK | 160 |
| | 69A7 | CD70 | QVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSS | 65 | EIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIK | 161 |
| CE-355621 | | cMET | QVQLVQSGAEVKKPGASVKVSCKASGYTFTSYGFSWVRQAPGQGLEWMGWISASNGNTYYAQKLQGRVTMTTDTSTSTAYMELRSLRDDTAVYYCARVYADYADYWGQGTLVTVSS | 66 | DIQMTQSPSSVSASVGDRVTITCRASQGINTWLAWYQQKPGKAPKLLIYAASSLKSGVPSRFSGSGSGTDFTLTISSLQPEDFATYYCQQANSFPLTFGGGTKVEIK | 162 |
| LY2875358 | emibetuzumab | cMET | QVQLVQSGAEVKKPGASVKVSCKASGYTFTDYYMHWVRQAPGQGLEWMGRVNPNRRGTTYNQKFEGRVTMTTDTSTSTAYMELRSLRDDTAVYYCARANWLDYWGQGTTVTVSS | 67 | DIQMTQSPSSLSASVGDRVTITCSVSSSVSSIYLHWYQQKPGKAPKLLIYSTSNLASGSRFSGSGSGTDFTLTISSLQPEDFATYYCQVYSGYPLTFGGGTKVEIK | 163 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| MetMAb | onartuzumab | cMET | EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSS | 68 | DIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIK | 164 |
| | tremelimumab (CP-675206, or 11.2.1) | CTLA4 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYGMDVWGQGTTVTVSS | 69 | DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK | 165 |
| Yervoy | Ipilimumab 10D1 | CTLA4 | QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS | 70 | EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK | 166 |
| AGS16F | H16-7.8 | ENPP3 | QVQLQESGPGLVKPSQTLSLTCTVSGGSISSGGYYWSWIRQHPGKGLEWIGIIYYSGSTYYNPSLKSRVTISVDTSKNQFSLKLNSVTAADTAVFYCARVAIVTTIPGGMDVWGQGTTVTVSS | 71 | EIVLTQSPDFQSVTPKEKVTITCRASQSIGISLHWYQQKPDQSPKLLIKYASQSFSGVPSRFSGSGSGTDFTLTINSLEAEDAATYYCHQSRSFPWTFGQGTKVEIK | 167 |
| MT110 | solitomab | EpCAm | EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS | 72 | ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK | 168 |
| MT201 | Adecatumumab | EpCAM | EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSS | 73 | ELQMTQSPSSLSASVGDRVTITCRTSQSISSYLNWYQQKPGQPPKLLIYWASTRESGVPDRFSGSGSGTDFTLTISSLQPEDSATYYCQQSYDIPYTFGQGTKLEIK | 169 |
| Panorex | Edrecolomab Mab CO17-1A | EpCAM | QVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARDGPWFAYWGQGTLVTVSA | 74 | NIVMTQSPKSMSMSVGERVTLTCKASENVTYVSWYQQKPEQSPKLLIYGASNRYTGVPDRFTGSGSATDFTLTISSVQAEDLADYHCGQGYSYPYTFGGGTKLEIK | 170 |
| | tucotuzumab | EpCAM | QIQLVQSGPELKKPGETVKISCKASGYTFTNYGMNWVRQAPGKGLKWMGWINTYTGEPTADDFKGRFVFSLETSASTAFLQLNNLRSEDTATYFCVRFISKGDYWGQGTSVTVSS | 75 | QILLTQSPAIMSASPGEKVTMTCSASSSVSYMLWYQQKPGSSPKPWIFDTSNLASGFPARFSGSGSGTSYSLIISMEAEDAATYYCHQRSGYPYTFGGGTKLEIK | 171 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| UBS-54 | | EpCAM | VQLQQSDAELVKPGA SVKISCKASGYTFTD HAIHWVKQNPEQGLE WIGYFSPGNDDFKYN ERFKGKATLTADKSS STAYVQLNSLTSEDS AVYFCTRSLNMAYWG QGTSVTVSS | 76 | DIVMTQSPDSLAVSL GERATINCKSSQSVL YSSNNKNYLAWYQQK PGQPPKLLIYWASTR ESGVPDRFSGSGSGT DFTLTISSLQAEDVA VYYCQQYYSYPLTFG GGTKVES | 172 |
| 3622W94 | 323/A3 | EpCAM | EVQLVQSGPEVKKPG ASVKVSCKASGYTFT NYGMNWVRQAPGQGL EWMGWINTYTGEPTY GEDFKGRFAFSLDTS ASTAYMELSSLRSED TAVYFCARFGNYVDY WGQGSLVTVSS | 77 | DIVMTQSPLSLPVTP GEPASISCRSSINKK GSNGITYLYWYLQKP GQSPQLLIYQMSNLA SGVPDRFSGSGSGTD FTLKISRVEAEDVGV YYCAQNLEIPRTFGQ GTKVEIK | 173 |
| 4D5MOCBv2 | | EpCAM | EVQLVQSGPGLVQPG GSVRISCAASGYTFT NYGMNWVKQAPGKGL EWMGWINTYTGESTY ADSFKGRFTFSLDTS ASAAYLQINSLRAED TAVYYCARFAIKGDY WGQGTLLTVSS | 78 | DIQMTQSPSSLSASV GDRVTITCRSTKSLL HSNGITYLYWYQQKP GKAPKLLIYQMSNLA SGVPSRFSSSGSGTD FTLTISSLQPEDFAT YYCAQNLEIPRTFGQ GTKVEIK | 174 |
| 4D5MOCB | | EpCAM | EVQLVQSGPGLVQPG GSVRISCAASGYTFT NYGMNWVKQAPGKGL EWMGWINTYTGESTY ADSFKGRFTFSLDTS ASAAYLQINSLRAED TAVYYCARFAIKGDY WGQGTLLTVSS | 78 | DIQMTQSPSSLSASV GDRVTITCRSTKSLL HSNGITYLYWYQQKP GKAPKLLIYQMSNLA SGVPSRFSSSGSGTD FTLTISSLQPEDFAT YYCAQNLEIPRTFGQ GTKVELK | 175 |
| MEDI-547 | 1C1 | EphA2 | EVQLLESGGGLVQPG GSLRLSCAASGFTFS HYMMAWVRQAPGKGL EWVSRIGPSGGPTHY ADSVKGRFTISRDNS KNTLYLQMNSLRAED TAVYYCAGYDSGYDY VAVAGPAEYFQHWGQ GTLVTVSS | 79 | DIQMTQSPSSLSASV GDRVTITCRASQSIS TWLAWYQQKPGKAPK LLIYKASNLHTGVPS RFSGSGSGTEFSLTI SGLQPDDFATYYCQQ YNSYSRTFGQGTKVE IK | 176 |
| MORAb-003 | farletuzumab | FOLR1 | EVQLVESGGGVVQPG RSLRLSCSASGFTFS GYGLSWVRQAPGKGL EWVAMISSGGSYTYY ADSVKGRFAISRDNA KNTLFLQMDSLRPED TGVYFCARHGDDPAW FAYWGQGTPVTVSS | 80 | DIQLTQSPSSLSASV GDRVTITCSVSSSIS SNNLHWYQQKPGKAP KPWIYGTSNLASGVP SRFSGSGSGTDYTFT ISSLQPEDIATYYCQ QWSSYPYMYTFGQGT KVEIK | 177 |
| M9346A | huMOV19 (vLCv1.00) | FOLR1 | QVQLVQSGAEVVKPG ASVKISCKASGYTFT GYFMNWVKQSPGQSL EWIGRIHPYDGDTFY NQKFQGKATLTVDKS SNTAHMELLSLTSED FAVYYCTRYDGSRAM DYWGQGTTVTVSS | 81 | DIVLTQSPLSLAVSL GQPAIISCKASQSVS FAGTSLMHWYHQKPG QQPRLLIYRASNLEA GVPDRFSGSGSKTDF TLNISPVEAEDAATY YCQQSREYPYTFGGG TKLEIK | 178 |
| M9346A | huMOV19 (vLCv1.60) | FOLR1 | QVQLVQSGAEVVKPG ASVKISCKASGYTFT GYFMNWVKQSPGQSL EWIGRIHPYDGDTFY NQKFQGKATLTVDKS SNTAHMELLSLTSED FAVYYCTRYDGSRAM DYWGQGTTVTVSS | 82 | DIVLTQSPLSLAVSL GQPAIISCKASQSVS FAGTSLMHWYHQKPG QQPRLLIYRASNLEA GVPDRFSGSGSKTDF TLTISPVEAEDAATY YCQQSREYPYTFGGG TKLEIK | 179 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| 26B3.F2 | | FOLR1 | GPELVKPGASVKISC KASDYSFTGYFMNWV MQSHGKSLEWIGRIF PYNGDTFYNQKFKGR ATLTVDKSSSTAHME LRSLASEDSAVYFCA RGTHYFDYWGQGTTL TVSS | 83 | PASLSASVGETVTIT CRTSENIFSYLAWYQ QKQGISPQLLVYNAK TLAEGVPSRFSGSGS GTQFSLKINSLQPED FGSYYCQHHYAFPWT FGGGSKLEIK | 180 |
| RG7686 | GC33 | GPC3 | QVQLVQSGAEVKKPG ASVKVSCKASGYTFT DYEMHWVRQAPGQGL EWMGALDPKTGDTAY SQKFKGRVTLTADKS TSTAYMELSSLTSED TAVYYCTRFYSYTYW GQGTLVTVSS | 84 | DVVMTQSPLSLPVTP GEPASISCRSSQSLV HSNGNTYLHWYLQKP GQSPQLLIYKVSNRF SGVPDRFSGSGSGTD FTLKISRVEAEDVGV YYCSQNTHVPPTFGQ GTKLEIK | 181 |
| | 4A6 | GPC3 | EVQLVQSGAEVKKPG ESLKISCKGSGYSFT SYWIAWVRQMPGKGL EWMGIIFPGDSDTRY SPSFQGQVTISADRS IRTAYLQWSSLKASD TALYYCARTREGYFD YWGQGTLVTVSS | 85 | EIVLTQSPGTLSLSP GERATLSCRAVQSVS SSYLAWYQQKPGQAP RLLIYGASSRATGIP DRFSGSGSGTDFTLT ISRLEPEDFAVYYCQ QYGSSPTFGGGTKVE IK | 182 |
| | 11E7 | GPC3 | EVQLVQSGAEVKKPG ESLKISCKGSGYSFT NYWIAvWVRQMPGKGL EWMGIIYPGDSDTRY SPSFQGQVTISADKS IRTAYLQWSSLKASD TAMYYCARTREGYFD YWGQGTLVTVSS | 86 | EIVLTQSPGTLSLSP GERATLSCRASQSVS SSYLAWYQQKPGQAP RLLIYGASSRATGIP DRFSGSGSGTDFTLT ISRLEPEDFAVYYCQ QYGSSPTFGGGTKVE IK | 183 |
| | 16D10 | GPC3 | EVQLVQSGADVTKPG ESLKISCKVSGYRFT NYWIGWMRQMSGKGL EWMGIIYPGDSDTRY SPSFQGHVTISADKS INTAYLRWSSLKASD TAIYYCARTREGFED YWGQGTPVTVSS | 87 | EILLTQSPGTLSLSP GERATLSCRASQSVS SSYLAWYQQKPGQAP RLLIYGASSRATGIP DRFSGSGSGTDFTLT ISRLEPEDFAVYYCQ QYGSSPTFGQGTKVE IK | 184 |
| AMG-595 | | HER1(EGFR) | QVQLVESGGGVVQSG RSLRLSCAASGFTFR NYGMHWVRQAPGKGL EWVAVIWYDGSDKYY ADSVRGRFTISRDNS KNTLYLQMNSLRAED TAVYYCARDGYDILT GNPRDFDYWGQGTLV TVSS | 88 | DTVMTQTPLSSHVTL GQPASISCRSSQSLV HSDGNTYLSWLQQRP GQPPRLLIYRISRRF SGVPDRFSGSGAGTD FTLEISRVEAEDVGV YYCMQSTHVPRTFGQ GTKVEIK | 185 |
| Erubitux ™ | cetutximab | HER1(EGFR) | QVQLKQSGPGLVQPS QSLSITCTVSGFSLT NYGVHWVRQSPGKGL EWLGVIWSGGNTDYN TPFTSRLSINKDNSK SQVFFKMNSLQSNDT AIYYCARALTYYDYE FAYWGQGTLVTVSA | 89 | DILLTQSPVILSVSP GERVSFSCRASQSIG TNIHWYQQRTNGSPR LLIKYASESISGIPS RFSGSGSGTDFTLSI NSVESEDIADYYCQQ NNNWPTTFGAGTKLE LK | 186 |
| GA201 | Imgatuzumab | HER1(EGFR) | QVQLVQSGAEVKKPG SSVKVSCKASGFTFT DYKIHWVRQAPGQGL EWMGYFNPNSGYSTY AQKFQGRVTITADKS TSTAYMELSSLRSED TAVYYCARLSPGGYY VMDAWGQGTTVTVSS | 90 | DIQMTQSPSSLSASV GDRVTITCRASQGIN NYLNWYQQKPGKAPK PLIYNTNNLQTGVPS RFSGSGSGTEFTLTI SSLQPEDFATYYCLQ HNSFPTFGQGTKLEIK | 187 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| Humax | zalutumumab | HER1(EGFR) | QVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSS | 91 | AIQLTQSPSSLSASVGDRVTITCRASQDISSALVWYQQKPGKAPKLLIYDASSLESGVPSRFSGSESGTDFTLTISSLQPEDFATYYCQQFNSYPLTFGGGTKVEIK | 188 |
| IMC-11F8 | necitumumab | HER1(EGFR) | QVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSS | 92 | EIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIK | 189 |
| MM-151 | P1X | HER1(EGFR) | QVQLVQSGAEVKKPGSSVKVSCKASGGTFSSYAISWVRQAPGQGLEWMGSIIPIFGTVNYAQKFQGRVTITADESTSTAYMELSSLRSEDTAVYYCARDPSVNLYWYFDLWGRGTLVTVSS | 93 | DIQMTQSPSTLSASVGDRVTITCRASQSISSWWAWYQQKPGKAPKLLIYDASSLESGVPSRFSGSGSGTEFTLTISSLQPDDFATYYCQQYHAHPTTFGGGTKVEIK | 190 |
| MM151 | P2X | HER1(EGFR) | QVQLVQSGAEVKKPGSSVKVSCKASGGTFGSYAISWVRQAPGQGLEWMGSIIPIFGAANPAQKSQGRVTITADESTSTAYMELSSLRSEDTAVYYCAKMGRGKVAFDIWGQGTMVTVSS | 94 | DIVMTQSPDSLAVSLGERATINCKSSQSVLYSPNNKNYLAWYQQKPGQPPKLLIYWASTRESGVPDRFSGSGSGTDFTLTISSLQAEDVAVYYCQQYYGSPITFGGGTKVEIK | 191 |
| MM-151 | P3X | HER1(EGFR) | QVQLVQSGAEVKKPGASVKVSCKASGYAFTSYGINWVRQAPGQGLEWMGWISAYNGNTYYAQKLRGRVTMTTDTSTSTAYMELRSLRSDDTAVYYCARDLGGYGSGSVPFDPWGQGTLVTVSS | 95 | EIVMTQSPATLSVSPGERATLSCRASQSVSSNLAWYQQKPGQAPRLLIYGASTRATGIPARFSGSGSGTEFTLTISSLQSEDFAVYYCQDYRTWPRRVFGGGTKVEIK | 192 |
| TheraCIM | nimotuzumab | HER1(EGFR) | QVQLQQSGAEVKKPGSSVKVSCKASGYTFTNYYIYWVRQAPGQGLEWIGGINPTSGGSNFNEKFKTRVTITADESTSTTAYMELSSLRSEDTAFYFCTRQLWFDSDGRGFDFWGQGTTVTVSS | 96 | DIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIT | 193 |
| Vectibix™ | panitumimab | HER1(EGFR) | QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS | 97 | DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIK | 194 |
| 07D06 | | HER1(EGFR) | QIQLVQSGPELKKPGETVKISCKASGYTFTEYPIHWVKQAPGKGFKWMGMIYTDIGKPTYAEEFKGRFAFSLETS | 98 | DVVMTQTPLSLPVSLGDQASISCRSSQSLVHSNGNTYLHWYLQKPGQSPKLLIYKVSNRFSGVPDRFSGSGSGTD | 195 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| | | | ASTAYLQINNLKNED TATYFCVRDRYDSLF DYWGQGTTLTVSS | | FTLKISRVEAEDLGV YFCSQSTHVPWTFGG GTKLEIK | |
| 12D03 | | HER1(EGFR) | EMQLVESGGGFVKPG GSLKLSCAASGFAFS HYDMSWVRQTPKQRL EWVAYIASGGDITYY ADTVKGRFTISRDNA QNTLYLQMSSLKSED TAMFYCSRSSYGNNG DALDFWGQGTSVTVS S | 99 | DVVMTQTPLSLPVSL GDQASISCRSSQSLV HSNGNTYLHWYLQKP GQSPKLLIYKVSNRF SGVPDRFSGSGSGTD FTLKISRVEAEDLGV YFCSQSTHVLTFGSG TKLEIK | 196 |
| | C1 | HER2 | QVQLVESGGGLVQPG GSLRLSCAASGFTFS SYAMGWVRQAPGKGL EWVSSISGSSRYIYY ADSVKGRFTISRDNS KNTLYLQMNSLRAED TAVYYCAKMDASGSY FNFWGQGTLVTVSS | 100 | QSPSFLSAFVGDRIT ITCRASPGIRNYLAW YQQKPGKAPKLLIYA ASTLQSGVPSRFSGS GSGTDFTLTISSLQP EDFATYYCQQYNSYP LSFGGGTKVEIK | 197 |
| Erbicin | | HER2 | QVQLLQSAAEVKKPG ESLKISCKGSGYSFT SYWIGWVRQMPGKGL EWMGIIYPGDSDTRY SPSFQGQVTISADKS ISTAYLQWSSLKASD TAVYYCARWRDSPLW GQGTLVTVSS | 101 | QAVVTQEPSFSVSPG GTVTLTCGLSSGSVS TSYYPSWYQQTPGQA PRTLIYSTNTRSSGV PDRFSGSILGNKAAL TITGAQADDESDYYC VLYMGSGQYVFGGGT KLTVL | 198 |
| Herceptin | trastuzumab | HER2 | EVQLVESGGGLVQPG GSLRLSCAASGFNIK DTYIHWVRQAPGKGL EWVARIYPTNGYTRY ADSVKGRFTISADTS KNTAYLQMNSLRAED TAVYYCSRWGGDGFY AMDYWGQGTLVTVSS | 102 | DIQMTQSPSSLSASV GDRVTITCRASQDVN TAVAWYQQKPGKAPK LLIYSASFLYSGVPS RFSGSRSGTDFTLTI SSLQPEDFATYYCQQ HYTTPPTFGQGTKVE IK | 199 |
| MAGH22 | margetuximab | HER2 | QVQLQQSGPELVKPG ASLKLSCTASGFNIK DTYIHWVKQRPEQGL EWIGRIYPTNGYTRY DPKFQDKATITADTS SNTAYLQVSRLTSED TAVYYCSRWGGDGFY AMDYWGQGASVTVSS | 103 | DIVMTQSHKFMSTSV GDRVSITCKASQDVN TAVAWYQQKPGHSPK LLIYSASFRYTGVPD RFTGSRSGTDFTFTI SSVQAEDLAVYYCQQ HYTTPPTFGGGTKVE IK | 200 |
| MM-302 | F5 | HER2 | QVQLVESGGGLVQPG GSLRLSCAASGFTFR SYAMSWVRQAPGKGL EWVSAISGRGDNTYY ADSVKGRFTISRDNS KNTLYLQMNSLRAED TAVYYCAKMTSNAFA FDYWGQGTLVTVSS | 104 | QSVLTQPPSVSGAPG QRVTISCTGSSSNIG AGYGVHWYQQLPGTA PKLLIYGNTNRPSGV PDRFSGFKSGTSASL AITGLQAEDEADYYC QFYDSSLSGWVFGGG TKLTVL | 201 |
| Perjeta | pertuzumab | HER2 | EVQLVESGGGLVQPG GSLRLSCAASGFTFT DYTMDWVRQAPGKGL EWVADVNPNSGGSIY NQRFKGRFTLSVDRS KNTLYLQMNSLRAED TAVYYCARNLGPSFY FDYWGQGTLVTVSS | 105 | DIQMTQSPSSLSASV GDRVTITCKASQDVS IGVAWYQQKPGKAPK LLIYSASYRYTGVPS RFSGSGSGTDFTLTI SSLQPEDFATYYCQQ YYIYPYTFGQGTKVE IK | 202 |
| MM-121/ SAR256212 | | HER3 | EVQLLESGGGLVQPG GSLRLSCAASGFTFS HYVMAWVRQAPGKGL EWVSSISSSGGWTLY ADSVKGRFTISRDNS KNTLYLQMNSLRAED | 106 | QSALTQPASVSGSPG QSITISCTGTSSDVG SYNVVSWYQQHPGKA PKLIIYEVSQRPSGV SNRFSGSKSGNTASL TISGLQTEDEADYYC | 203 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| | | | TAVYYCTRGLKMATI FDYWGQGTLVTVSS | | CSYAGSSIFVIFGGG TKVTVL | |
| MEHD7945A | Duligotumab | HER1 (EGFR)/ HER3 | EVQLVESGGGLVQPG GSLRLSCAASGFTLS GDWIHWVRQAPGKGL EWVGEISAAGGYTDY ADSVKGRFTISADTS KNTAYLQMNSLRAED TAVYYCARESRVSFE AAMDYWGQGTLVTVS S | 107 | DIQMTQSPSSLSASV GDRVTITCRASQNIA TDVAWYQQKPGKAPK LLIYSASFLYSGVPS RFSGSGSGTDFTLTI SSLQPEDFATYYCQQ SEPEPYTFGQGTKVE IK | 204 |
| MM-111 | | HER2/3 | QVQLQESGGGLVKPG GSLRLSCAASGFTFS SYWMSWVRQAPGKGL EWVANINRDGSASYY VDSVKGRFTISRDDA KNSLYLQMNSLRAED TAVYYCARDRGVGYF DLWGRGTLVTVSS | 108 | QSALTQPASVSGSPG QSITISCTGTSSDVG GYNFVSWYQQHPGKA PKLMIYDVSDRPSGV SDRFSGSKSGNTASL IISGLQADDEADYYC SSYGSSSTHVIFGGG TKVTVL | 205 |
| MM-111 | | HER2/3 | QVQLVQSGAEVKKPG ESLKISCKGSGYSFT SYWIAWVRQMPGKGL EYMGLIYPGDSDTKY SPSFQGQVTISVDKS VSTAYLQWSSLKPSD SAVYFCARHDVGYCT DRTCAKWPEWLGVWG QGTLVTVSS | 109 | QSVLTQPPSVSAAPGQ KVTISCSGSSSNIGN NYVSWYQQLPGTAPK LLIYDHTNRPAGVPD RFSGSKSGTSASLAI SGFRSEDEADYYCAS WDYTLSGWVFGGGTK LTVL | 206 |
| | Hu3S193 | Lewis-Y | EVQLVESGGGVVQP GRSLRLSCSTSGFT FSDYYMYWVRQAPG KGLEWVAYMSNVGA ITDYPDTVKGRFTI SRDNSKNTLFLQMD SLRPEDTGVYFCAR GTRDGSWFAYWGQG TPVTVSS | 110 | DIQMTQSPSSLSAS VGDRVTITCRSSQR IVHSNGNTYLEWYQ QTPGKAPKLLIYKV SNRFSGVPSRFSGS GSGTDFTFTISSLQ PEDIATYYCFQGSH VPFTFGQGTKLQIT | 207 |
| BAY94-9343 | anetumab ravtansine | Mesothelin | QVELVQSGAEVKKPG ESLKISCKGSGYSFT SYWIGWVRQAPGKGL EWMGIIDPGDSRTRY SPSFQGQVTISADKS ISTAYLQWSSLKASD TAMYYCARGQLYGGT YMDGWGQGTLVTVSS | 111 | DIALTQPASVSGSPG QSITISCTGTSSDIG GYNSVSWYQQHPGKA PKLMIYGVNNRPSGV SNRFSGSKSGNTASL TISGLQAEDEADYYC SSYDIESATPVFGGG TKLTVL | 208 |
| | SS1 | Mesothelin | QVQLQQSGPELEKPG ASVKISCKASGYSFT GYTMNWVKQSHGKSL EWIGLITPYNGASSY NQKFRGKATLTVDKS SSTAYMDLLSLTSED SAVYFCARGGYDRG FDYWGQGTTVTVSS | 112 | DIELTQSPAIMSASP GEKVTMTCSASSSVS YMHWYQQKSGTSPKR WIYDTSKLASGVPGR FSGSGSGNSYSLTIS SVEAEDDATYYCQQW SGYPLTFGAGTKLEIK | 209 |
| | | Mesothelin | QVYLVESGGGVVQPG RSLRLSCAASGITFS IYGMHWVRQAPGKGL EWVAVIWYDGSHEYY ADSVKGRFTISRDNS KNTLYLLMNSLRAED TAVYYCARDGDYDS GSPLDYWGQGTLVTV SS | 113 | EIVLTQSPATLSLSP GERATLSCRASQSVS SYLAWYQQKPGQAPR LLIYDASNRATGIPA RFSGSGSGTDFTLTI SSLEPEDFAVYYCQQ RSNWPLTFGGGTKVE IK | 210 |
| | | Mesothelin | QVHLVESGGGVVQPG RSLRLSCVASGITFR IYGMHWVRQAPGKGL EWVAVLWYDGSHEYY | 114 | EIVLTQSPATLSLSP GERATLSCRASQSVS SYLAWYQQKPGQAPR LLIYDASNRAT**GIPA | 210 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| | | | ADSVKGRFTISRDNS KNTLYLQMNSLRAED TAIYYCARDGDYYDS GSPLDYWGQGTLVTV SS | | RFSGSGSGTDFTLTI SSLEPEDFAVYYCQQ RSNWPLTFGGGTKVE IK | |
| | | Mesothelin | EVHLVESGGGLVQPG GSLRLSCAASGFTFS RYWMSWVRQAQGKGL EWVASIKQAGSEKTY VDSVKGRFTISRDNA KNSLSLQMNSLRAED TAVYYCAREGAYYYD SASYYPYYYYYSMDV WGQGTTVTVSS | 115 | EIVLTQSPGTLSLSP GERATLSCRASQSVS SSYLAWYQQKPGQAP RLLIYGASSRATGIP DRFSGSGSGTDFTLT ISRLEPEDFAVYYCQ QYGSSQYTFGQGTKL EIK | 211 |
| MORAb-009 | amatuximab | Mesothelin | QVQLQQSGPELEKPG ASVKISCKASGYSFT GYTMNWVKQSHGKSL EWIGLITPYNGASSY NQKFRGKATLTVDKS SSTAYMDLLSLTSED SAVYFCARGGYDGRG FDYWGSGTPVTVSS | 116 | DIELTQSPAIMSASP GEKVTMTCSASSSVS YMHWYQQKSGTSPKR WIYDTSKLASGVPGR FSGSGSGNSYSLTIS SVEAEDDATYYCQQW SKHPLTFGSGTKVEI K | 212 |
| hPAM4 | | MUC-1 | EVQLQESGPELVKPG ASVKMSCKASGYTFP SYVLHWVKQKPGQGL EWIGYINPYNDGTQY NEKFKGKATLTSDKS SSTAYMELSRLTSED SAVYYCARGFGGSYG FAYWGQGTLITVSA | 117 | DIVMTQSPAIMSASP GEKVTMTCSASSSVS SSYLYWYQQKPGSSP KLWIYSTSNLASGVP ARFSGSGSGTSYSLT ISSMEAEDAASYFCH QWNRYPYTFGGGTKL EIK | 213 |
| hPAM4-Cide | clivatuzumab | MUC1 | QVQLQQSGAEVKKFG ASVKVSCEASGYTFP SYVLHWVKQAPGQGL EWIGYINPYNDGTQT NKKFKGKATLTRDTS INTAYMELSRLRSDD TAVYYCARGFGGSYG FAYNGQGTLVTVSS | 118 | DIQLTQSPSSLSASV GDRVTMTCSASSSVS SSYLYWYQQKPGKAP KLWIYSTSNLASGVP ARFSGSGSGTDFTLT ISSLQPEDSASYFCH QWNRYPYTFGGGTRL EIK | 214 |
| SAR566658 | huDS6v1.01 | MUC1 | QAQLQVSGAEVVKPG ASVKMSCKASGYTFT SYNMHWVKQTPGQGL EWIGYIYPGNGATNY NQKFQGKATLTADTS SSTAYMQISSLTSED SAVYFCARGDSVPFA YWGQGTLVTVSA | 119 | EIVLTQSPATMSASP GERVTITCSAHSSVS FMHWFQQKPGTSPKL WIYSTSSLASGVPAR FGGSGSGTSYSLTIS SMEAEDAATYYCQQR SSFPLTFGAGTKLEL K | 215 |
| Theragyn | Pemtumomab muHMFG1 | MUC1 | QVQLQQSGAELMKPG ASVKISCKATGYTFS AYWIEWVKQRPGHGL EWIGEILPGSNNSRY NEKFKGKATFTADTS SNTAYMQLSSLTSED SAVYYCSRYDFAWF AYWGQGTPVTVSA | 120 | DIVMSQSPSSLAVSV GEKVTMSCKSSQSLL YSSNQKIYLAWYQQK PGQSPKLLIYWASTR ESGVPDRFTGGSGT DFTLTISSVKAEDLA VYYCQQYRYPRTFG GGTKLEIK | 216 |
| Therex | Sontuzumab huHMFG1 AS1402 R1150 | MUC1 | QVQLVQSGAEVKKPG ASVKVSCKASGYTFS AYWIEWVRQAPGKGL EWVGEILPGSNNSRY NEKFKGRVTVTRDTS TNTAYMELSSLRSED TAVYYCARSYDFAWF AYWGQGTLVTVSS | 121 | DIQMTQSPSSLSASV GDRVTITCKSSQSLL YSSNQKIYLAWYQQK PGKAPKLLIYWASTR ESGVPSRFSGSGSGT DFTFTISSLQPEDIA TYYCQQYRYPRTFG QGTKVEIK | 217 |
| MDX-1105 or BMS-936559 | | PD-L1 | QVQLVQSGAEVKKPG SSVKVSCKTSGDTFS TYAISWVRQAPGQGL EWMGGIIPIFGKAHY | 122 | EIVLTQSPATLSLSP GERATLSCRASQSVS SYLAWYQQKPGQAPR LLIYDASNRATGIPA | 218 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| | | | AQKFQGRVTITADES TSTAYMELSSLRSED TAVYFCARKFHFVSG SPFGMDVWGQGTTVT VSS | | RFSGSGSGTDFTLTI SSLEPEDFAVYYCQQ RSNWPTFGQGTKVEI K | |
| MEDI-4736 | durvalumab | PD-L1 | EVQLVESGGGLVQPG GSLRLSCAASGFTFS RYWMSWVRQAPGKGL EWVANIKQDGSEKYY VDSVKGRFTISRDNA KNSLYLQMNSLRAED TAVYYCAREGGWFGE LAFDYWGQGTLVTVS S | 123 | EIVLTQSPGTLSLSP GERATLSCRASQRVS SSYLAWYQQKPGQAP RLLIYDASSRATGIP DRFSGSGSGTDFTLT ISRLEPEDFAVYYCQ QYGSLPWTFGQGTKV EIK | 219 |
| MPDL3280A | atezolizumab | PD-L1 | EVQLVESGGGLVQPG GSLRLSCAASGFTFS DSWIHWVRQAPGKGL EWVAWISPYGGSTYY ADSVKGRFTISADTS KNTAYLQMNSLRAED TAVYYCARRHWPGGF DYWGQGTLVTVSS | 124 | DIQMTQSPSSLSASV GDRVTITCRASQDVS TAVAWYQQKPGKAPK LLIYSASFLYSGVPS RFSGSGSGTDFTLTI SSLQPEDFATYYCQQ YLYHPATFGQGTKVE IK | 220 |
| MSB0010718C | avelumab | PD-L1 | EVQLLESGGGLVQPG GSLRLSCAASGFTFS SYIMMWVRQAPGKGL EWVSSIYPSGGITFY ADTVKGRFTISRDNS KNTLYLQMNSLRAED TAVYYCARIKLGTVT TVDYWGQGTLVTVSS | 125 | QSALTQPASVSGSPG QSITISCTGTSSDVG GYNYVSWYQQHPGKA PKLMIYDVSNRPSGV SNRFSGSKSGNTASL TISGLQAEDEADYYC SSYTSSSTRVFGTGT KVTVL | 221 |
| MLN591 | | PSMA | EVQLVQSGPEVKKPG ATVKISCKTSGYTFT EYTIHWVKQAPGKGL EWIGNINPNNGGTTY NQKFEDKATLTVDKS TDTAYMELSSLRSED TAVYYCAAGWNFDYW GQGTLLTVSS | 126 | DIQMTQSPSSLSTSV GDRVTLTCKASQDVG TAVDWYQQKPGPSPK LLIYWASTRHTGIPS RFSGSGSGTDFTLTI SSLQPEDFADYYCQQ YNSYPLTFGPGTKVD IK | 222 |
| MT112 | pasotuxizumab | PSMA | QVQLVESGGGLVKPG ESLRLSCAASGFTFS DYYMWVRQAPGKGL EWVAIISDGGYYTYY SDIIKGRFTISRDNA KNSLYLQMNSLKAED TAVYYCARGFPLLRH GAMDYWGQGTLVTVS S | 127 | DIQMTQSPSSLSASV GDRVTITCKASQNVD TNVAWYQQKPGQAPK SLIYSASYRYSDVPS RFSGSASGTDFTLTI SSVQSEDFATYYCQQ YDSYPYTFGGGTKLE IK | 223 |
| | | ROR1 | QEQLVESGGRLVTPG GSLTLSCKASGFDFS AYYMSWVRQAPGKGL EWIATIYPSSGKTYY ATWVNGRFTISSDNA QNTVDLQMNSLTAAD RATYFCARDSYADDG ALFNIWGPGTLVTIS S | 128 | ELVLTQSPSVSAALG SPAKITCTLSSAHKT DTIDWYQQLQGEAPR YLMQVQSDGSYTKRP GVPDRFSGSSSGADR YLIIPSVQADDEADY YCGADYIGGYVFGGG TQLTVTG | 224 |
| | | ROR1 | EVKLVESGGGLVKPG GSLKLSCAASGFTFS SYAMSWVRQIPEKRL EWVASISRGGTTYYP DSVKGRFTISRDNVR NILYLQMSSLRSEDT AMYYCGRYDYGYYA MDYWGQGTSVTVSS | 129 | DIKMTQSPSSMYASL GERVTITCKASPDIN SYLSWFQQKPGKSPK TLIYRANRLVDGVPS RFSGGGSGQDYSLTI NSLEYEDMGIYYCLQ YDEFPYTFGGGTKLE MK | 225 |
| | | ROR1 | QSLEESGGRLVTPGT PLTLTCTVSGIDLNS | 130 | ELVMTQTPSSVSAAV GGTVTINCQASQSIG | 226 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| | | | HWMSWVRQAPGKGLE WIGIIAASGSTYYAN WAKGRFTISKTSTTV DLRIASPTTEDTATY FCARDYGDYRLVTFN IWGPGTLVTVSS | | SYLAWYQQKPGQPPK LLIYYASNLASGVPS RFSGSGSGTEYTLTI SGVQREDAATYYCLG SLSNSDNVFGGGTEL EIL | |
| | | ROR1 | QSVKESEGDLVTPAG NLTLTCTASGSDINDD YPISWVRQAPGKGLE WIGFINSGGSTWYAS WVKGRFTISRTSTTV DLKMTSLTTDDTATY FCARGYSTYYCDFNI WGPGTLVTISS | 131 | ELVMTQTPSSTSGAV GGTVTINCQASQSID SNLAWFQQKPGQPPT LLIYRASNLASGVPS RFSGSRSGTEYTLTI SGVQREDAATYYCLG GVGNVSYRTSFGGGT EVVVK | 227 |
| CC49 (Humanizeds) | | TAG-72 | QVQLVQSGAEVVKPG ASVKISCKASGYTFTDHAIHWVKQNPGQRL EWIGYFSPGNDDFKY NERFKGKATLTADTS ASTAYVELSSLRSED TAVYFCTRSLNMAYW GQGTLVTVSS | 132 | DIVMSQSPDSLAVSL GERVTLNCKSSQSLL YSGNQKNYLAWYQQK PGQSPKLLIYWASAR ESGVPDRFSGSGSGT DFTLTISSVQAEDVA VYYCQQYYSYPLTFG AGTKLELK | 228 |
| | Murine A1 | TPBG/ 5T4 | QIQLVQSGPELKKP GETVKISCKASGYT FTNFGMNWVKQGPG EGLKWMGWINTNTG EPRYAEEFKGRXAF SLETTASTAYLQIN NLKNEDTATYFCAR DWDGAYFFDYWGQG TTLTVSS | 133 | SIVMTQTPKFLLVS AGDRVTITCKASQS VSNDVAWYQQKPGQ SPKLLINFATNRYT GVPNRFTGSGYGTD FTFTISTVQAEDLA LYFCQQ DYSSPWTFGGGTKL EIK | 229 |
| | Murine A2 | TPBG/ 5T4 | QVQLQQSRPELVKP GASVKMSCKASGYT FTDYVISWVKQRTG QGLEWIGEIYPGSN SIYYNEKFKGRATL TA DKSSSTAYMQLSSL TSEDSAVYFCAMGG NYGFDYWGQGTTLT VSS | 134 | SVIMSRGQIVLTQS PAIMSASLGERVTL TCTASSSVNSNYLH WYQQKPGSSPKLWI YSTSNLASGVPARF SGSGSGTSYSLTIS SMEAEDAATYYCHQ YHRSPLTFGAGTKL ELK | 230 |
| | Murine A3 | TPBG/ 5T4 | EVQLVESGGGLVQP KGSLKLSCAASGFT FNTYAMNWVRQAPG KGLEWVARIRSKSN NYATYYADSVKDRF TISRDDSQSMLYLQ MNNLKTEDTAMYXC VRQWDYDVRAMNYW GQGTSVTVSS | 135 | DIVMTQSHIFMSTS VGDRVSITCKASQD VDTAVAWYQQKPGQ SPKLLIYWASTRLT GVPDRFTGSGSGTD FTLTISNVQSEDLA DYFCQQ YSSYPYTFGGGTKL EIK | 231 |
| IMMU-132 | hRS-7 | TROP-2 | QVQLQQSGSELKKPG ASVKVSCKASGYTFT NYGMNWVKQAPGQGL KWMGWINTYTGEPTY TDDFKGRFAFSLDTS VSTAYLQISSLKADD TAVYFCARGGFGSSY WYFDVWGQGSLVTVS S | 136 | DIQLTQSPSSLSASV GDRVSITCKASQDVS IAVAWYQQKPGKAPK LLIYSASYRYTGVPD RFSGSGSGTDFTLTI SSLQPEDFAVYYCQQ HYITPLTFGAGTKVE IK | 232 |
| IMC-18F1 | icrucumab | VEGFR1 | QAQVVESGGGVVQSG RSLRLSCAASGFAFS SYGMHWVRQAPGKGL EWVAVIWYDGSNKYY | 137 | EIVLTQSPGTLSLSP GERATLSCRASQSVS SSYLAWYQQKPGQAP RLLIYGASSRATGIP | 233 |

TABLE 2-continued

Anti-target Cell Monoclonal Antibodies and Sequences

| Trade Name | Antibody Name | Target | VH Sequence | SEQ ID NO: | VL Sequence | SEQ ID NO: |
|---|---|---|---|---|---|---|
| | | | ADSVRGRFTISRDNS ENTLYLQMNSLRAED TAVYYCARDHYGSGV HHYFYYGLDVWGQGT TVTVSS | | DRFSGSGSGTDFTLT ISRLEPEDFAVYYCQ QYGSSPLTFGGGTKV EIK | |
| Cyramza | ramucirumab | VEGFR2 | EVQLVQSGGGLVKPG GSLRLSCAASGFTFS SYSMNWVRQAPGKGL EWVSSISSSSSYIYY ADSVKGRFTISRDNA KNSLYLQMNSLRAED TAVYYCARVTDAFDI WGQGTMVTVSSA | 138 | DIQMTQSPSSVSASI GDRVTITCRASQGID NWLGWYQQKPGKAPK LLIYDASNLDTGVPS RFSGSGSGTYFTLTI SSLQAEDFAVYFCQQ AKAFPPTFGGGTKVD IK | 234 |
| g165DFM-PEG | alacizumab pegol | VEGFR2 | EVQLVESGGGLVQPG GSLRLSCAASGFTFS SYGMSWVRQAPGKGL EWVATITSGGSYTYY VDSVKGRFTISRDNA KNTLYLQMNSLRAED TAVYYCVRIGEDALD YWGQGTLVTVSS | 139 | DIQMTQSPSSLSASV GDRVTITCRASQDIA GSLNWLQQKPGKAIK RLIYATSSLDSGVPK RFSGSRSGSDYTLTI SSLQPEDFATYYCLQ YGSFPPTFGQGTKVE IK | 235 |
| Imclone6.64 | | VEGFR2 | KVQLQQSGTELVKPG ASVKVSCKASGYIFT EYIIHWVKQRSGQGL EWIGWLYPESNIIKY NEKFKDKATLTADKS SSTVYMELSRLTSED SAVYFCTRHDGTNFD YWGQGTTLTVSSA | 140 | DIVLTQSPASLAVSL GQRATISCRASESVD SYGNSFMHWYQQKPG QPPKLLIYRASNLES GIPARFSGSGSRTDF TLTINPVEADDVATY YCQQSNEDPLTFGAG TKLELK | 236 |

*underlined & bolded sequences, if present, are CDRs within the VL and VH

Methods to measure binding affinity and/or other biologic activity of the subject compositions of the invention can be those disclosed herein or methods generally known in the art. For example, the binding affinity of a binding pair (e.g., antibody and antigen), denoted as $K_d$, can be determined using various suitable assays including, but not limited to, radioactive binding assays, non-radioactive binding assays such as fluorescence resonance energy transfer and surface plasmon resonance (SPR, Biacore), and enzyme-linked immunosorbent assays (ELISA), kinetic exclusion assay (KinExA®) or as described in the Examples. An increase or decrease in binding affinity, for example of a chimeric polypeptide assembly which has been cleaved to remove a bulking moiety compared to the chimeric polypeptide assembly with the bulking moiety attached, can be determined by measuring the binding affinity of the chimeric polypeptide assembly to its target binding partner with and without the bulking moiety.

Measurement of half-life of a subject chimeric assembly can be performed by various suitable methods. For example, the half-life of a substance can be determined by administering the substance to a subject and periodically sampling a biological sample (e.g., biological fluid such as blood or plasma or ascites) to determine the concentration and/or amount of that substance in the sample over time. The concentration of a substance in a biological sample can be determined using various suitable methods, including enzyme-linked immunosorbent assays (ELISA), immunoblots, and chromatography techniques including high-pressure liquid chromatography and fast protein liquid chromatography. In some cases, the substance may be labeled with a detectable tag, such as a radioactive tag or a fluorescence tag, which can be used to determine the concentration of the substance in the sample (e.g., a blood sample or a plasma sample. The various pharmacokinetic parameters are then determined from the results, which can be done using software packages such as SoftMax Pro software, or by manual calculations known in the art.

In addition, the physicochemical properties of the chimeric polypeptide assembly compositions may be measured to ascertain the degree of solubility, structure and retention of stability. Assays of the subject compositions are conducted that allow determination of binding characteristics of the binding domains towards a ligand, including binding dissociation constant ($K_d$, $K_{on}$ and $K_{off}$), the half-life of dissociation of the ligand-receptor complex, as well as the activity of the binding domain to inhibit the biologic activity of the sequestered ligand compared to free ligand ($IC_{50}$ values). The term "$IC_{50}$" refers to the concentration needed to inhibit half of the maximum biological response of the ligand agonist, and is generally determined by competition binding assays. The term "$EC_{50}$" refers to the concentration needed to achieve half of the maximum biological response of the active substance, and is generally determined by ELISA or cell-based assays, including the methods of the Examples described herein.

(i) Anti-CD3 Binding Domains

In some embodiments, the invention provides chimeric polypeptide assembly compositions comprising a binding domain of the first portion with binding affinity to T cells. In one embodiment, the binding domain of the second portion comprises VL and VH derived from a monoclonal antibody to an antigen of the CD3. In another embodiment, the binding domain comprises VL and VH derived from a monoclonal antibody to CD3epsilon and CD3delta. Monoclonal antibodies to CD3 neu are known in the art. Exemplary, non-limiting examples of VL and VH sequences of monoclonal antibodies to CD3 are presented in Table 1. In one embodiment, the invention provides a chimeric polypeptide assembly comprising a binding domain with binding affinity to CD3 comprising anti-CD3 VL and VH sequences set forth in Table 1. In another embodiment, the invention provides a chimeric polypeptide assembly comprising a binding domain of the first portion with binding affinity to CD3epsilon comprising anti-CD3epsilon VL and VH sequences set forth in Table 1. In another embodiment, the invention provides a chimeric polypeptide assembly composition, wherein the scFv second binding domain of the first portion comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the huUCHT1 anti-CD3 antibody of Table 1. In another embodiment, the invention provides a chimeric polypeptide assembly composition comprising a binding domain with binding affinity to CD3 comprising the CDR-L1 region, the CDR-L2 region, the CDR-L3 region, the CDR-H1 region, the CDR-H2 region, and the CDR-H3 region, wherein each is derived from the respective anti-CD3 VL and VH sequences set forth in Table 1. In another embodiment, the invention provides a chimeric polypeptide assembly composition comprising a binding domain with binding affinity to CD3 comprising the CDR-L1 region, the CDR-L2 region, the CDR-L3 region, the CDR-H1 region, the CDR-H2 region, and the CDR-H3 region, wherein the CDR sequences are RASQDIRNYLN (SEQ ID NO: 237), YTSRLES (SEQ ID NO: 238), QQGNTLPWT (SEQ ID NO: 239), GYSFTGYTMN (SEQ ID NO: 240), LINPYKGVST (SEQ ID NO: 241), and SGYYGDSDWYFDV (SEQ ID NO: 242)

The CD3 complex is a group of cell surface molecules that associates with the T-cell antigen receptor (TCR) and functions in the cell surface expression of TCR and in the signaling transduction cascade that originates when a peptide:MHC ligand binds to the TCR. Typically, when an antigen binds to the T-cell receptor, the CD3 sends signals through the cell membrane to the cytoplasm inside the T cell. This causes activation of the T cell that rapidly divide to produce new T cells sensitized to attack the particular antigen to which the TCR were exposed. The CD3 complex is comprised of the CD3epsilon molecule, along with four other membrane-bound polypeptides (CD3-gamma, -delta, -zeta, and -beta). In humans, CD3-epsilon is encoded by the CD3E gene on Chromosome 11. The intracellular domains of each of the CD3 chains contain immunoreceptor tyrosine-based activation motifs (ITAMs) that serve as the nucleating point for the intracellular signal transduction machinery upon T cell receptor engagement.

A number of therapeutic strategies modulate T cell immunity by targeting TCR signalling, particularly the anti-human CD3 monoclonal antibodies (mAbs) that are widely used clinically in immunosuppressive regimes. The CD3-specific mouse mAb OKT3 was the first mAb licensed for use in humans (Sgro, C. Side-effects of a monoclonal antibody, muromonab CD3/orthoclone OKT3: bibliographic review. Toxicology 105:23-29, 1995) and is widely used clinically as an immunosuppressive agent in transplantation (Chatenoud, Clin. Transplant 7:422-430, (1993); Chatenoud, Nat. Rev. Immunol. 3:123-132 (2003); Kumar, Transplant. Proc. 30:1351-1352 (1998)), type 1 diabetes, and psoriasis. Importantly, anti-CD3 mAbs can induce partial T cell signalling and clonal anergy (Smith, J A, Nonmitogenic Anti-CD3 Monoclonal Antibodies Deliver a Partial T Cell Receptor Signal and Induce Clonal Anergy J. Exp. Med. 185:1413-1422 (1997)). OKT3 has been described in the literature as a T cell mitogen as well as a potent T cell killer (Wong, J T. The mechanism of anti-CD3 monoclonal antibodies. Mediation of cytolysis by inter-T cell bridging. Transplantation 50:683-689 (1990)). In particular, the studies of Wong demonstrated that by bridging CD3 T cells and target cells, one could achieve killing of the target and that neither FcR-mediated ADCC nor complement fixation was necessary for bivalent anti-CD3 MAB to lyse the target cells.

OKT3 exhibits both a mitogenic and T-cell killing activity in a time-dependent fashion; following early activation of T cells leading to cytokine release, upon further administration OKT3 later blocks all known T-cell functions. It is due to this later blocking of T cell function that OKT3 has found such wide application as an immunosuppressant in therapy regimens for reduction or even abolition of allograft tissue rejection. Other antibodies specific for the CD3 molecule are disclosed in Tunnacliffe, Int. Immunol. 1 (1989), 546-50, WO2005/118635 and WO2007/033230 describe anti-human monoclonal CD3 epsilon antibodies, U.S. Pat. No. 5,821,337 describes the VL and VH sequences of murine anti-CD3 monoclonal Ab UCHT1 (muxCD3, Shalaby et al., J. Exp. Med. 175, 217-225 (1992) and a humanized variant of this antibody (hu UCHT1), and United States Patent Application 20120034228 discloses binding domains capable of binding to an epitope of human and non-chimpanzee primate CD3 epsilon chain.

(ii) Anti-EpCAM Binding Domains

In some embodiments, the invention provides chimeric polypeptide assembly compositions comprising a binding domain with binding affinity to the tumor-specific marker EpCAM. In one embodiment, the binding domain comprises VL and VH derived form a monoclonal antibody to EpCAM. Monoclonal antibodies to EpCAM are known in the art. Exemplary, non-limiting examples of EpCAM monoclonal antibodies and the VL and VH sequences thereof are presented in Table 2. In one embodiment, the invention provides a chimeric polypeptide assembly composition comprising a binding domain with binding affinity to the tumor-specific marker EpCAM comprising anti-EpCAM VL and VH sequences set forth in Table 2. In another embodiment, the invention provides a chimeric polypeptide assembly composition, wherein the first portion first binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the 4D5MUCB anti-EpCAM antibody of Table 2. In another embodiment, the invention provides a chimeric polypeptide assembly composition comprising a binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2.

Epithelial cell adhesion molecule (EpCAM, also known as 17-1A antigen) is a 40-kDa membrane-integrated glycoprotein composed of 314 amino acids expressed in certain epithelia and on many human carcinomas (see, Balzar, The biology of the 17-1A antigen (Ep-CAM), J. Mol. Med. 1999, 77:699-712). EpCAM was initially discovered by use of the murine monoclonal antibody 17-1A/edrecolomab that was generated by immunization of mice with colon carcinoma cells (Goettlinger, Int J Cancer. 1986; 38, 47-53 and Simon, Proc. Natl. Acad. Sci. USA. 1990; 87, 2755-2759). Because of their epithelial cell origin, tumor cells from most carcinomas express EpCAM on their surface (more so than normal, healthy cells), including the majority of primary, metastatic, and disseminated non-small cell lung carcinoma cells (Passlick, B., et al. The 17-1A antigen is expressed on primary, metastatic and disseminated non-small cell lung carcinoma cells. Int. J. Cancer 87(4):548-552, 2000), gastric and gastro-oesophageal junction adenocarcinomas (Martin, I. G., Expression of the 17-1A antigen in gastric and gastro-oesophageal junction adenocarcinomas: a potential immunotherapeutic target? J Clin Pathol 1999; 52:701-704), and breast and colorectal cancer (Packeisen J, et al. Detection of surface antigen 17-1A in breast and colorectal cancer. Hybridoma. 1999 18(1):37-40) and, therefore, are an attractive target for immunotherapy approaches. Indeed, increased expression of EpCAM correlates to increased epithelial proliferation; in breast cancer, overexpression of EpCAM on tumor cells is a predictor of survival (Gastl, Lancet. 2000, 356, 1981-1982). Due to their epithelial cell origin, tumor cells from most carcinomas still express EpCAM on their surface, and the bispecific solitomab single-chain antibody composition that targets EpCAM on tumor cells and also contains a CD3 binding region has been proposed for use against primary uterine and ovarian CS cell lines (Ferrari F, et al., Solitomab, an EpCAM/CD3 bispecific antibody construct (BiTE®), is highly active against primary uterine and ovarian carcinosarcoma cell lines in vitro. J Exp Clin Cancer Res. 2015 34:123).

Monoclonal antibodies to EpCAM are known in the art. The EpCAM monclonals ING-1, 3622W94, adecatumumab and edrecolomab have been described as having been tested in human patients (Münz, M. Side-by-side analysis of five clinically tested anti-EpCAM monoclonal antibodies Cancer Cell International, 10:44-56, 2010). Bispecific antibodies directed against EpCAM and against CD3 have also been described, including construction of two different bispecific antibodies by fusing a hybridoma producing monoclonal antibody against EpCAM with either of the two hybridomas OKT3 and 9.3 (Möller, S A, Reisfeld, R A, Bispecific-monoclonal-antibody-directed lysis of ovarian carcinoma cells by activated human T lymphocytes. Cancer Immunol. Immunother. 33:210-216, 1991). Other examples of bispecific antibodies against EpCAM include BiUII, (anti-CD3 (rat)×anti-EpCAM (mouse)) (Zeidler, J. Immunol., 1999, 163:1247-1252), a scFv CD3/17-1A-bispecific (Mack, M. A small bispecific antibody composition expressed as a functional single-chain molecule with high tumor cell cytotoxicity. Proc. Natl. Acad. Sci., 1995, 92:7021-7025), and a partially humanized bispecific diabody having anti-CD3 and antiEpCAM specificity (Helfrich, W. Construction and characterization of a bispecific diabody for retargeting T cells to human carcinomas. Int. J. Cancer, 1998, 76:232-239).

In one embodiment provided herein are bispecific chimeric polypeptide assembly compositions with a first portion having a binding domain specific for EpCAM and a binding domain specific for CD3. The technical problem to be solved was to provide means and methods for the generation of improved compositions exhibiting the properties of being well-tolerated and more convenient medicaments (less frequent dosing) for the effective treatment and or amelioration of tumorous diseases. The solution to said technical problem is achieved by the embodiments disclosed herein and characterized in the claims.

Accordingly, in some embodiments, the present invention relates to chimeric polypeptide assembly compositions whereby said composition comprises a first portion comprising a bispecific single chain antibody composition comprising at least two binding domains, whereby one of said domains binds to an effector cell antigen, such as CD3 antigen and a second domain binds to EpCAM antigen, wherein said binding domains comprise VL and VH specific for EpCAM and VL and VH specific for human CD3 antigen. Preferably, in the embodiment, said binding domain specific for EpCAM has a $K_d$ value of greater than $10^{-7}$ to $10^{-10}$ M, as determined in an vitro binding assay. In one embodiment of the foregoing, the binding domains are in a scFv format. In another embodiment of the foregoing, the binding domains are in a single chain diabody format.

(iii) Anti-CCR5 Binding Domains

In some embodiments, the invention provides chimeric polypeptide assembly compositions comprising a first portion binding domain with binding affinity to the tumor-specific marker CCR5 and a second binding domain binds to an effector cell antigen, such as CD3 antigen. In one embodiment, the binding domain comprises VL and VH derived form a monoclonal antibody to CCR5. Monoclonal antibodies to CCR5 are known in the art. In one embodiment, the invention provides a chimeric polypeptide assembly composition comprising a first portion binding domain with binding affinity to the tumor-specific marker CCR5 comprising anti-CCR5 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(iv) Anti-CD19 Binding Domains

In some embodiments, the invention provides chimeric polypeptide assembly compositions comprising a first portion binding domain with binding affinity to the tumor-specific marker CD19 and a second binding domain binds to an effector cell antigen, such as CD3 antigen. In one embodiment, the binding domain comprises VL and VH derived form a monoclonal antibody to CD19. Monoclonal antibodies to CD19 are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker CD19 comprising anti-CD19 VL and VH sequences set forth in Table 2. In another embodiment, the invention provides a chimeric polypeptide assembly composition, wherein the scFv second binding domain comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the MT103 anti-CD19 antibody of Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(v) Anti-HER-2 Binding Domains

In some embodiments, the invention provides chimeric polypeptide assembly compositions comprising a first portion binding domain with binding affinity to the tumor-specific marker HER-2 and a second binding domain binds to an effector cell antigen, such as CD3 antigen. In one embodiment, the binding domain comprises VL and VH derived form a monoclonal antibody to HER-2. Monoclonal antibodies to HER-2 are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker HER-2 comprising anti-HER-2 VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(vi) Anti-HER-3 Binding Domains

In some embodiments, the invention provides chimeric polypeptide assembly compositions comprising a first portion binding domain with binding affinity to the tumor-specific marker HER-3 and a second binding domain binds to an effector cell antigen, such as CD3 antigen. In one embodiment, the binding domain comprises VL and VH derived form a monoclonal antibody to HER-3. Monoclonal antibodies to HER-3 are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker HER-3 comprising anti-HER-3 VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(vii) Anti-HER-4 Binding Domains

In some embodiments, the invention provides chimeric polypeptide assembly compositions comprising a first portion binding domain with binding affinity to the tumor-specific marker HER-4 and a second binding domain binds to an effector cell antigen, such as CD3 antigen. In one embodiment, the binding domain comprises VL and VH derived form a monoclonal antibody to HER-4. Monoclonal antibodies to HER-4 are known in the art. In one embodiment, the invention provides a chimeric polypeptide assembly composition comprising a first portion binding domain with binding affinity to the tumor-specific marker HER-4 comprising anti-HER-4 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(viii) Anti-EGFR Binding Domains

In some embodiments, the invention provides chimeric polypeptide assembly compositions comprising a first portion binding domain with binding affinity to the tumor-specific marker EGFR and a second binding domain binds to an effector cell antigen, such as CD3 antigen. In one embodiment, the binding domain comprises VL and VH derived form a monoclonal antibody to EGFR. Monoclonal antibodies to EGFR are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker EGFR comprising anti-EGFR VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(ix) Anti-PSMA Binding Domains

In some embodiments, the invention provides chimeric polypeptide assembly compositions comprising a first portion binding domain with binding affinity to the tumor-specific marker PSMA and a second binding domain binds to an effector cell antigen, such as CD3 antigen. In one embodiment, the binding domain comprises VL and VH derived form a monoclonal antibody to PSMA. Monoclonal antibodies to PSMA are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker PSMA comprising anti-PSMA VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(x) Anti-CEA Binding Domains

In some embodiments, the invention provides chimeric polypeptide assembly compositions comprising a first portion binding domain with binding affinity to the tumor-specific marker CEA and a second binding domain binds to an effector cell antigen, such as CD3 antigen. In one embodiment, the binding domain comprises VL and VH derived form a monoclonal antibody to CEA. Monoclonal antibodies to CEA are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker CEA comprising anti-CEA VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(xi) Anti-MUC1 Binding Domains

In some embodiments, the invention provides chimeric polypeptide assembly compositions comprising a first portion binding domain with binding affinity to the tumor-specific marker MUC1 and a second binding domain binds to an effector cell antigen, such as CD3 antigen. In one embodiment, the binding domain comprises VL and VH derived form a monoclonal antibody to MUC1. Monoclonal antibodies to MUC1 are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker MUC1 comprising anti-MUC1 VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(xii) Anti-MUC2 Binding Domains

In some embodiments, the invention provides chimeric polypeptide assembly compositions comprising a first portion binding domain with binding affinity to the tumor-specific marker MUC2 and a second binding domain binds to an effector cell antigen, such as CD3 antigen. In one embodiment, the binding domain comprises VL and VH derived form a monoclonal antibody to MUC2. Monoclonal antibodies to MUC2 are known in the art. In one embodiment, the invention provides a chimeric polypeptide assembly composition comprising a first portion binding domain with binding affinity to the tumor-specific marker MUC2 comprising anti-MUC2 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xiii) Anti-MUC3 Binding Domains

In some embodiments, the invention provides chimeric polypeptide assembly compositions comprising a first portion binding domain with binding affinity to the tumor-specific marker MUC3 and a second binding domain binds to an effector cell antigen, such as CD3 antigen. In one embodiment, the binding domain comprises VL and VH derived form a monoclonal antibody to MUC3. Monoclonal antibodies to MUC3 are known in the art. In one embodiment, the invention provides a chimeric polypeptide assembly composition comprising a first portion binding domain with binding affinity to the tumor-specific marker MUC3 comprising the anti-MUC3 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xiv) Anti-MUC4 Binding Domains

In some embodiments, the invention provides chimeric polypeptide assembly compositions comprising a first portion binding domain with binding affinity to the tumor-specific marker MUC4 and a second binding domain binds to an effector cell antigen, such as CD3 antigen. In one embodiment, the binding domain comprises VL and VH derived form a monoclonal antibody to MUC4. Monoclonal antibodies to MUC4 are known in the art. In one embodiment, the invention provides a chimeric polypeptide assembly composition comprising a first portion binding domain with binding affinity to the tumor-specific marker MUC4 comprising anti-MUC4 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xv) Anti-MUC5AC Binding Domains

In some embodiments, the invention provides chimeric polypeptide assembly compositions comprising a first portion binding domain with binding affinity to the tumor-specific marker MUC5AC and a second binding domain binds to an effector cell antigen, such as CD3 antigen. In one embodiment, the binding domain comprises VL and VH derived form a monoclonal antibody to MUC5AC. Monoclonal antibodies to MUC5AC are known in the art. In one embodiment, the invention provides a chimeric polypeptide assembly composition comprising a first portion binding domain with binding affinity to the tumor-specific marker MUC5AC comprising anti-MUC5AC VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xvi) Anti-MUC5B Binding Domains

In some embodiments, the invention provides chimeric polypeptide assembly compositions comprising a first portion binding domain with binding affinity to the tumor-specific marker MUC5B and a second binding domain binds to an effector cell antigen, such as CD3 antigen. In one embodiment, the binding domain comprises VL and VH derived form a monoclonal antibody to MUC5B. Monoclonal antibodies to MUC5B are known in the art. In one embodiment, the invention provides a chimeric polypeptide assembly composition comprising a first portion binding domain with binding affinity to the tumor-specific marker MUC5B comprising anti-MUC5B VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xvii) Anti-MUC7 Binding Domains

In some embodiments, the invention provides chimeric polypeptide assembly compositions comprising a first portion binding domain with binding affinity to the tumor-specific marker MUC7 and a second binding domain binds to an effector cell antigen, such as CD3 antigen. In one embodiment, the binding domain comprises VL and VH derived form a monoclonal antibody to MUC7. Monoclonal antibodies to MUC7 are known in the art. In one embodiment, the invention provides a chimeric polypeptide assembly composition comprising a first portion binding domain with binding affinity to the tumor-specific marker MUC7 comprising anti-MUC7 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xviii) Anti-βhCG Binding Domains

In some embodiments, the invention provides chimeric polypeptide assembly compositions comprising a first portion binding domain with binding affinity to the tumor-specific marker βhCG and a second binding domain binds to an effector cell antigen, such as CD3 antigen. In one embodiment, the binding domain comprises VL and VH derived form a monoclonal antibody to βhCG. Monoclonal antibodies to βhCG are known in the art. In one embodiment, the invention provides a chimeric polypeptide assembly composition comprising a first portion binding domain with binding affinity to the tumor-specific marker βhCG comprising anti-βhCG VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xix) Anti-Lewis-Y Binding Domains

In some embodiments, the invention provides chimeric polypeptide assembly compositions comprising a first portion binding domain with binding affinity to the tumor-specific marker Lewis-Y and a second binding domain binds to an effector cell antigen, such as CD3 antigen. In one embodiment, the binding domain comprises VL and VH derived form a monoclonal antibody to Lewis-Y. Monoclonal antibodies to Lewis-Y are known in the art. In one embodiment, the invention provides a chimeric polypeptide assembly composition comprising a first portion binding domain with binding affinity to the tumor-specific marker Lewis-Y comprising the anti-Lewis-Y VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from respective VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xx) Anti-CD20 Binding Domains

In some embodiments, the invention provides chimeric polypeptide assembly compositions comprising a first portion binding domain with binding affinity to the tumor-specific marker CD20 and a second binding domain binds to an effector cell antigen, such as CD3 antigen. In one embodiment, the binding domain comprises VL and VH derived form a monoclonal antibody to CD20. Monoclonal antibodies to CD20 are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker CD20 comprising anti-CD20 VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(xxi) Anti-CD33 Binding Domains

In some embodiments, the invention provides chimeric polypeptide assembly compositions comprising a first portion binding domain with binding affinity to the tumor-specific marker CD33 and a second binding domain binds to an effector cell antigen, such as CD3 antigen. In one embodiment, the binding domain comprises VL and VH derived form a monoclonal antibody to CD33. Monoclonal antibodies to CD33 are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker CD33 comprising anti-CD33 VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(xxii) Anti-CD30 Binding Domains

In some embodiments, the invention provides chimeric polypeptide assembly compositions comprising a first portion binding domain with binding affinity to the tumor-specific marker CD30 and a second binding domain binds to an effector cell antigen, such as CD3 antigen. In one embodiment, the binding domain comprises VL and VH derived form a monoclonal antibody to CD30. Monoclonal antibodies to CD30 are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker CD30 comprising anti-CD30 VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(xxiii) Anti-Ganglioside GD3 Binding Domains

In some embodiments, the invention provides chimeric polypeptide assembly compositions comprising a first portion binding domain with binding affinity to the tumor-specific marker ganglioside GD3 and a second binding domain binds to an effector cell antigen, such as CD3 antigen. In one embodiment, the binding domain comprises VL and VH derived form a monoclonal antibody to ganglioside GD3. Monoclonal antibodies to ganglioside GD3 are known in the art. In one embodiment, the invention provides a chimeric polypeptide assembly composition comprising a first portion binding domain with binding affinity to the tumor-specific marker ganglioside GD3 comprising anti-ganglioside GD3 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxiv) Anti-9-O-Acetyl-GD3 Binding Domains

In some embodiments, the invention provides chimeric polypeptide assembly compositions comprising a first portion binding domain with binding affinity to the tumor-specific marker 9-O-Acetyl-GD3 and a second binding domain binds to an effector cell antigen, such as CD3 antigen. In one embodiment, the binding domain comprises VL and VH derived form a monoclonal antibody to 9-O-Acetyl-GD3. Monoclonal antibodies to 9-O-Acetyl-GD3 are known in the art. In one embodiment, the invention provides a chimeric polypeptide assembly composition comprising a first portion binding domain with binding affinity to the tumor-specific marker 9-O-Acetyl-GD3 comprising the anti-9-O-Acetyl-GD3 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxv) Anti-Globo H Binding Domains

In some embodiments, the invention provides chimeric polypeptide assembly compositions comprising a first portion binding domain with binding affinity to the tumor-specific marker Globo H and a second binding domain binds to an effector cell antigen, such as CD3 antigen. In one embodiment, the binding domain comprises VL and VH derived form a monoclonal antibody to Globo H. Monoclonal antibodies to Globo H are known in the art. In one embodiment, the invention provides a chimeric polypeptide assembly composition comprising a first portion binding domain with binding affinity to the tumor-specific marker Globo H comprising anti-Globo H VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxvi) Anti-Fucosyl GM1 Binding Domains

In some embodiments, the invention provides chimeric polypeptide assembly compositions comprising a first portion binding domain with binding affinity to the tumor-specific marker fucosyl GM1 and a second binding domain binds to an effector cell antigen, such as CD3 antigen. In one embodiment, the binding domain comprises VL and VH derived form a monoclonal antibody to fucosyl GM1. Monoclonal antibodies to fucosyl GM1 are known in the art. In one embodiment, the invention provides a chimeric polypeptide assembly composition comprising a first portion binding domain with binding affinity to the tumor-specific marker fucosyl GM1 comprising anti-fucosyl GM1 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxvii) Anti-GD2 Binding Domains

In some embodiments, the invention provides chimeric polypeptide assembly compositions comprising a first portion binding domain with binding affinity to the tumor-specific marker GD2 and a second binding domain binds to an effector cell antigen, such as CD3 antigen. In one embodiment, the binding domain comprises VL and VH derived form a monoclonal antibody to GD2. Monoclonal antibodies to GD2 are known in the art. In one embodiment, the invention provides a chimeric polypeptide assembly composition comprising a first portion binding domain with binding affinity to the tumor-specific marker GD2 comprising anti-GD2 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-1}$ M, as determined in an vitro binding assay.

(xxviii) Anti-Carbonicanhydrase IX Binding Domains

In some embodiments, the invention provides chimeric polypeptide assembly compositions comprising a first portion binding domain with binding affinity to the tumor-specific marker carbonicanhydrase IX and a second binding domain binds to an effector cell antigen, such as CD3 antigen. In one embodiment, the binding domain comprises VL and VH derived form a monoclonal antibody to carbonicanhydrase IX. Monoclonal antibodies to carbonicanhydrase IX are known in the art. In one embodiment, the invention provides a chimeric polypeptide assembly composition comprising a first portion binding domain with binding affinity to the tumor-specific marker carbonicanhydrase IX comprising anti-carbonicanhydrase IX VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxix) Anti-CD44v6 Binding Domains

In some embodiments, the invention provides chimeric polypeptide assembly compositions comprising a first portion binding domain with binding affinity to the tumor-specific marker CD44v6 and a second binding domain binds to an effector cell antigen, such as CD3 antigen. In one embodiment, the binding domain comprises VL and VH derived form a monoclonal antibody to CD44v6. Monoclonal antibodies to CD44v6 are known in the art. In one embodiment, the invention provides a chimeric polypeptide assembly composition comprising a first portion binding domain with binding affinity to the tumor-specific marker CD44v6 comprising anti-CD44v6 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxx) Anti-Sonic Hedgehog Binding Domains

In some embodiments, the invention provides chimeric polypeptide assembly compositions comprising a first portion binding domain with binding affinity to the tumor-specific marker Sonic Hedgehog and a second binding domain binds to an effector cell antigen, such as CD3 antigen. In one embodiment, the binding domain comprises VL and VH derived form a monoclonal antibody to Sonic Hedgehog. Monoclonal antibodies to Sonic Hedgehog are known in the art. In one embodiment, the invention provides a chimeric polypeptide assembly composition comprising a first portion binding domain with binding affinity to the tumor-specific marker Sonic Hedgehog comprising anti-Sonic Hedgehog VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxxi) Anti-Wue-1 Binding Domains

In some embodiments, the invention provides chimeric polypeptide assembly compositions comprising a first portion binding domain with binding affinity to the tumor-specific marker Wue-1 and a second binding domain binds to an effector cell antigen, such as CD3 antigen. In one embodiment, the binding domain comprises VL and VH derived form a monoclonal antibody to Wue-1. Monoclonal antibodies to Wue-1 are known in the art. In one embodiment, the invention provides a chimeric polypeptide assembly composition comprising a first portion binding domain with binding affinity to the tumor-specific marker Wue-1 comprising anti-Wue-1 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxxii) Anti-Plasma Cell Antigen 1 Binding Domains

In some embodiments, the invention provides chimeric polypeptide assembly compositions comprising a first portion binding domain with binding affinity to the tumor-specific marker plasma cell antigen 1 and a second binding domain binds to an effector cell antigen, such as CD3 antigen. In one embodiment, the binding domain comprises VL and VH derived form a monoclonal antibody to plasma cell antigen 1. Monoclonal antibodies to plasma cell antigen 1 are known in the art. In one embodiment, the invention provides a chimeric polypeptide assembly composition comprising a first portion binding domain with binding affinity to the tumor-specific marker plasma cell antigen 1 comprising anti-plasma cell antigen 1 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxxiii) Anti-Melanoma Chondroitin Sulfate Proteoglycan Binding Domains

In some embodiments, the invention provides chimeric polypeptide assembly compositions comprising a first portion binding domain with binding affinity to the tumor-specific marker melanoma chondroitin sulfate proteoglycan and a second binding domain binds to an effector cell antigen, such as CD3 antigen. In one embodiment, the binding domain comprises VL and VH derived form a monoclonal antibody to melanoma chondroitin sulfate proteoglycan. Monoclonal antibodies to melanoma chondroitin sulfate proteoglycan are known in the art. In one embodiment, the invention provides a chimeric polypeptide assembly composition comprising a first portion binding domain with binding affinity to the tumor-specific marker melanoma chondroitin sulfate proteoglycan comprising anti-melanoma chondroitin sulfate proteoglycan VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxxiv) Anti-CCR8 Binding Domains

In some embodiments, the invention provides chimeric polypeptide assembly compositions comprising a first portion binding domain with binding affinity to the tumor-specific marker CCR8 and a second binding domain binds to an effector cell antigen, such as CD3 antigen. In one embodiment, the binding domain comprises VL and VH derived form a monoclonal antibody to CCR8. Monoclonal antibodies to CCR8 are known in the art. In one embodiment, the invention provides a chimeric polypeptide assembly composition comprising a first portion binding domain with binding affinity to the tumor-specific marker CCR8 comprising anti-CCR8 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxxv) Anti-STEAP Binding Domains

In some embodiments, the invention provides chimeric polypeptide assembly compositions comprising a first portion binding domain with binding affinity to the tumor-specific marker 6-transmembrane epithelial antigen of prostate (STEAP) and a second binding domain binds to an effector cell antigen, such as CD3 antigen. In one embodiment, the binding domain comprises VL and VH derived form a monoclonal antibody to STEAP. Monoclonal antibodies to STEAP are known in the art. In one embodiment, the invention provides a chimeric polypeptide assembly composition comprising a first portion binding domain with binding affinity to the tumor-specific marker STEAP comprising anti-STEAP VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxxvi) Anti-Mesothelin Binding Domains

In some embodiments, the invention provides chimeric polypeptide assembly compositions comprising a first portion binding domain with binding affinity to the tumor-specific marker mesothelin and a second binding domain binds to an effector cell antigen, such as CD3 antigen. In one embodiment, the binding domain comprises VL and VH derived form a monoclonal antibody to mesothelin. Monoclonal antibodies to mesothelin are known in the art. In one embodiment, the invention provides a chimeric polypeptide assembly composition comprising a first portion binding domain with binding affinity to the tumor-specific marker mesothelin comprising anti-mesothelin VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxxvii) Anti-A33 Antigen Binding Domains

In some embodiments, the invention provides chimeric polypeptide assembly compositions comprising a first portion binding domain with binding affinity to the tumor-specific marker A33 antigen and a second binding domain binds to an effector cell antigen, such as CD3 antigen. In one embodiment, the binding domain comprises VL and VH derived form a monoclonal antibody to A33 antigen. Monoclonal antibodies to A33 antigen are known in the art. In one embodiment, the invention provides a chimeric polypeptide assembly composition comprising a first portion binding domain with binding affinity to the tumor-specific marker A33 antigen comprising anti-A33 antigen VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xxxviii) Anti-PSCA Binding Domains

In some embodiments, the invention provides chimeric polypeptide assembly compositions comprising a first portion binding domain with binding affinity to the tumor-specific marker prostate stem cell antigen (PSCA) and a second binding domain binds to an effector cell antigen, such as CD3 antigen. In one embodiment, the binding domain comprises VL and VH derived form a monoclonal antibody to PSCA. Monoclonal antibodies to PSCA are known in the art. In one embodiment, the invention provides a chimeric polypeptide assembly composition comprising a first portion binding domain with binding affinity to the tumor-specific marker PSCA comprising anti-PSCA VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH (xxxix) Anti-Ly-6 Binding Domains In some embodiments, the invention provides chimeric polypeptide assembly compositions comprising a first portion binding domain with binding affinity to the tumor-specific marker Ly-6 and a second binding domain binds to an effector cell antigen, such as CD3 antigen. In one embodiment, the binding domain comprises VL and VH derived form a monoclonal antibody to LY-6. Monoclonal antibodies to LY-6 are known in the art. In one embodiment, the invention provides a chimeric polypeptide assembly composition comprising a first portion binding domain with binding affinity to the tumor-specific marker LY-6 comprising anti-LY-6 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xl) Anti-SAS Binding Domains

In some embodiments, the invention provides chimeric polypeptide assembly compositions comprising a first portion binding domain with binding affinity to the tumor-specific marker SAS and a second binding domain binds to an effector cell antigen, such as CD3 antigen. In one embodiment, the binding domain comprises VL and VH derived form a monoclonal antibody to SAS. Monoclonal antibodies to SAS are known in the art. In one embodiment, the invention provides a chimeric polypeptide assembly composition comprising a first portion binding domain with binding affinity to the tumor-specific marker SAS comprising anti-SAS VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xli) Anti-Desmoglein 4 Binding Domains

In some embodiments, the invention provides chimeric polypeptide assembly compositions comprising a first portion binding domain with binding affinity to the tumor-specific marker desmoglein 4 and a second binding domain binds to an effector cell antigen, such as CD3 antigen. In one embodiment, the binding domain comprises VL and VH derived form a monoclonal antibody to desmoglein 4. Monoclonal antibodies to desmoglein 4 are known in the art. In one embodiment, the invention provides a chimeric polypeptide assembly composition comprising a first portion binding domain with binding affinity to the tumor-specific marker desmoglein 4 comprising anti-desmoglein 4 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xlii) Anti-Fetal Acetylcholine Receptor Binding Domains

In some embodiments, the invention provides chimeric polypeptide assembly compositions comprising a first portion binding domain with binding affinity to the tumor-specific marker fetal acetylcholine receptor and a second binding domain binds to an effector cell antigen, such as CD3 antigen. In one embodiment, the binding domain comprises VL and VH derived form a monoclonal antibody to fetal acetylcholine receptor. Monoclonal antibodies to fetal acetylcholine receptor are known in the art. In one embodiment, the invention provides a chimeric polypeptide assembly composition comprising a first portion binding domain with binding affinity to the tumor-specific marker fetal acetylcholine receptor comprising anti-fetal acetylcholine receptor VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xliii) Anti-CD25 Binding Domains

In some embodiments, the invention provides chimeric polypeptide assembly compositions comprising a first portion binding domain with binding affinity to the tumor-specific marker CD25 and a second binding domain binds to an effector cell antigen, such as CD3 antigen. In one embodiment, the binding domain comprises VL and VH derived form a monoclonal antibody to CD25. Monoclonal antibodies to CD25 are known in the art; e.g., daclizumab. In one embodiment, the invention provides a chimeric polypeptide assembly composition comprising a first portion binding domain with binding affinity to the tumor-specific marker CD25 comprising anti-CD25 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(Xliv) Anti-Cancer Antigen 19-9 Binding Domains

In some embodiments, the invention provides chimeric polypeptide assembly compositions comprising a first portion binding domain with binding affinity to the tumor-specific marker cancer antigen 19-9 (CA 19-9) and a second binding domain binds to an effector cell antigen, such as CD3 antigen. In one embodiment, the binding domain comprises VL and VH derived form a monoclonal antibody to CA 19-9. Monoclonal antibodies to CA 19-9 are known in the art. In one embodiment, the invention provides a chimeric polypeptide assembly composition comprising a first portion binding domain with binding affinity to the tumor-specific marker CA 19-9 comprising anti-cancer antigen 19-9 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xlv) Anti-CA-125 Binding Domains

In some embodiments, the invention provides chimeric polypeptide assembly compositions comprising a first portion binding domain with binding affinity to the tumor-specific marker cancer antigen 125 (CA-125) and a second binding domain binds to an effector cell antigen, such as CD3 antigen. In one embodiment, the binding domain comprises VL and VH derived form a monoclonal antibody to CA-125. Monoclonal antibodies to CA-125 are known in the art. In one embodiment, the invention provides a chimeric polypeptide assembly composition comprising a first portion binding domain with binding affinity to the tumor-specific marker CA-125 comprising anti-CA-125 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xlvi) Anti-MISIIR Binding Domains

In some embodiments, the invention provides chimeric polypeptide assembly compositions comprising a first portion binding domain with binding affinity to the tumor-specific marker Muellerian inhibitory substance type II receptor (MISIIR) and a second binding domain binds to an effector cell antigen, such as CD3 antigen. In one embodiment, the binding domain comprises VL and VH derived form a monoclonal antibody to MIS. Monoclonal antibodies to MISIIR are known in the art. In one embodiment, the invention provides a chimeric polypeptide assembly composition comprising a first portion binding domain with binding affinity to the tumor-specific marker MISIIR comprising anti-MISIIR VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(Xlvii) Anti-Sialylated Tn Antigen Binding Domains

In some embodiments, the invention provides chimeric polypeptide assembly compositions comprising a first portion binding domain with binding affinity to the tumor-specific marker sialylated Tn antigen and a second binding domain binds to an effector cell antigen, such as CD3 antigen. In one embodiment, the binding domain comprises VL and VH derived form a monoclonal antibody to sialylated Tn antigen. Monoclonal antibodies to sialylated Tn antigen are known in the art. In one embodiment, the invention provides a chimeric polypeptide assembly composition comprising a first portion binding domain with binding affinity to the tumor-specific marker sialylated Tn antigen comprising anti-sialylated Tn antigen VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xlviii) Anti-FAP Binding Domains

In some embodiments, the invention provides chimeric polypeptide assembly compositions comprising a first portion binding domain with binding affinity to the tumor-specific marker fibroblast activation antigen (FAP) and a second binding domain binds to an effector cell antigen, such as CD3 antigen. In one embodiment, the binding domain comprises VL and VH derived form a monoclonal antibody to FAP. Monoclonal antibodies to FAP are known in the art. In one embodiment, the invention provides a chimeric polypeptide assembly composition comprising a first portion binding domain with binding affinity to the tumor-specific marker FAP comprising anti-FAP VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(xlix) Anti-CD248 Binding Domains

In some embodiments, the invention provides chimeric polypeptide assembly compositions comprising a first portion binding domain with binding affinity to the tumor-specific marker endosialin (CD248) and a second binding domain binds to an effector cell antigen, such as CD3 antigen. In one embodiment, the binding domain comprises VL and VH derived form a monoclonal antibody to CD248. Monoclonal antibodies to CD248 are known in the art. In one embodiment, the invention provides a chimeric polypeptide assembly composition comprising a first portion binding domain with binding affinity to the tumor-specific marker CD248 comprising anti-CD248 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(l) Anti-EGFRvIII Binding Domains

In some embodiments, the invention provides chimeric polypeptide assembly compositions comprising a first portion binding domain with binding affinity to the tumor-specific marker epidermal growth factor receptor variant III (EGFRvIII) and a second binding domain binds to an effector cell antigen, such as CD3 antigen. In one embodiment, the binding domain comprises VL and VH derived form a monoclonal antibody to EGFRvIII. Monoclonal antibodies to EGFRvIII are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker EGFRvIII comprising the anti-EGFRvIII VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(li) Anti-TAL6 Binding Domains

In some embodiments, the invention provides chimeric polypeptide assembly compositions comprising a first portion binding domain with binding affinity to the tumor-specific marker tumor-associated antigen L6 (TAL6) and a second binding domain binds to an effector cell antigen, such as CD3 antigen. In one embodiment, the binding domain comprises VL and VH derived form a monoclonal antibody to TAL6. Monoclonal antibodies to TAL6 are known in the art. In one embodiment, the invention provides a chimeric polypeptide assembly composition comprising a first portion binding domain with binding affinity to the tumor-specific marker TAL6 comprising anti-TAL6 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lii) Anti-SAS Binding Domains

In some embodiments, the invention provides chimeric polypeptide assembly compositions comprising a first portion binding domain with binding affinity to the tumor-specific marker tumor-associated antigen SAS and a second binding domain binds to an effector cell antigen, such as CD3 antigen. In one embodiment, the binding domain comprises VL and VH derived form a monoclonal antibody to SAS. Monoclonal antibodies to SAS are known in the art. In one embodiment, the invention provides a chimeric polypeptide assembly composition comprising a first portion binding domain with binding affinity to the tumor-specific marker SAS comprising anti-SAS VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(liii) Anti-CD63 Binding Domains

In some embodiments, the invention provides chimeric polypeptide assembly compositions comprising a first portion binding domain with binding affinity to the tumor-specific marker tumor-associated antigen CD63 and a second binding domain binds to an effector cell antigen, such as CD3 antigen. In one embodiment, the binding domain comprises VL and VH derived form a monoclonal antibody to CD63. Monoclonal antibodies to CD63 are known in the art. In one embodiment, the invention provides a chimeric polypeptide assembly composition comprising a first portion binding domain with binding affinity to the tumor-specific marker CD63 comprising anti-CD63 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(liv) Anti-TAG72 Binding Domains

In some embodiments, the invention provides chimeric polypeptide assembly compositions comprising a first portion binding domain with binding affinity to the tumor-specific marker tumor-associated antigen TAG72 and a second binding domain binds to an effector cell antigen, such as CD3 antigen. In one embodiment, the binding domain comprises VL and VH derived form a monoclonal antibody to TAG72. Monoclonal antibodies to TAG72 are known in the art. Exemplary, non-limiting examples of VL and VH sequences are presented in Table 2. In one embodiment, the invention provides a chimeric polypeptide assembly composition comprising a first portion binding domain with binding affinity to the tumor-specific marker TAG72 comprising the anti-TAG72 VL and VH sequences set forth in Table 2. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 2. Preferably, in the embodiments, said binding has a $K_d$ value of greater than $10^{-7}$ to $10^{-10}$ M, as determined in an vitro binding assay.

(lv) Anti-TF-ANTIGEN Binding Domains

In some embodiments, the invention provides chimeric polypeptide assembly compositions comprising a first portion binding domain with binding affinity to the tumor-specific marker tumor-associated antigen Thomsen-Friedenreich antigen (TF-antigen) and a second binding domain binds to an effector cell antigen, such as CD3 antigen. In one embodiment, the binding domain comprises VL and VH derived form a monoclonal antibody to TF-antigen. Monoclonal antibodies to TF-antigen are known in the art. In one embodiment, the invention provides a chimeric polypeptide assembly composition comprising a first portion binding domain with binding affinity to the tumor-specific marker TF-antigen comprising anti-TF-antigen VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lvi) Anti-IGF-IR Binding Domains

In some embodiments, the invention provides chimeric polypeptide assembly compositions comprising a first portion binding domain with binding affinity to the tumor-specific marker tumor-associated antigen insulin-like growth factor I receptor (IGF-IR) and a second binding domain binds to an effector cell antigen, such as CD3 antigen. In one embodiment, the binding domain comprises VL and VH derived form a monoclonal antibody to IGF-IR. Monoclonal antibodies to IGF-IR are known in the art. In one embodiment, the invention provides a chimeric polypeptide assembly composition comprising a first portion binding domain with binding affinity to the tumor-specific marker IGF-IR comprising anti-IGF-IR VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lvii) Anti-Cora Antigen Binding Domains

In some embodiments, the invention provides chimeric polypeptide assembly compositions comprising a first portion binding domain with binding affinity to the tumor-specific marker tumor-associated antigen Cora antigen and a second binding domain binds to an effector cell antigen, such as CD3 antigen. In one embodiment, the binding domain comprises VL and VH derived form a monoclonal antibody to Cora antigen. Monoclonal antibodies to Cora antigen are known in the art. In one embodiment, the invention provides a chimeric polypeptide assembly composition comprising a first portion binding domain with binding affinity to the tumor-specific marker Cora antigen comprising anti-Cora antigen VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lviii) Anti-CD7 Binding Domains

In some embodiments, the invention provides chimeric polypeptide assembly compositions comprising a first portion binding domain with binding affinity to the tumor-specific marker tumor-associated antigen CD7 and a second binding domain binds to an effector cell antigen, such as CD3 antigen. In one embodiment, the binding domain comprises VL and VH derived form a monoclonal antibody to CD7. Monoclonal antibodies to CD7 are known in the art. In one embodiment, the invention provides a chimeric polypeptide assembly composition comprising a first portion binding domain with binding affinity to the tumor-specific marker CD7 comprising anti-CD7 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lix) Anti-CD22 Binding Domains

In some embodiments, the invention provides chimeric polypeptide assembly compositions comprising a first portion binding domain with binding affinity to the tumor-specific marker tumor-associated antigen CD22 and a second binding domain binds to an effector cell antigen, such as CD3 antigen. In one embodiment, the binding domain comprises VL and VH derived form a monoclonal antibody to CD22. Monoclonal antibodies to CD22 are known in the art. In one embodiment, the invention provides a chimeric polypeptide assembly composition comprising a first portion binding domain with binding affinity to the tumor-specific marker CD22 comprising anti-CD22 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lx) Anti-CD79a Binding Domains

In some embodiments, the invention provides chimeric polypeptide assembly compositions comprising a first portion binding domain with binding affinity to the tumor-specific marker tumor-associated antigen CD79a and a second binding domain binds to an effector cell antigen, such as CD3 antigen. In one embodiment, the binding domain comprises VL and VH derived form a monoclonal antibody to CD79a. Monoclonal antibodies to CD79a are known in the art. In one embodiment, the invention provides a chimeric polypeptide assembly composition comprising a first portion binding domain with binding affinity to the tumor-specific marker CD79a comprising anti-CD79a VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lxi) Anti-CD79b Binding Domains

In some embodiments, the invention provides chimeric polypeptide assembly compositions comprising a first portion binding domain with binding affinity to the tumor-specific marker tumor-associated antigen CD79b and a second binding domain binds to an effector cell antigen, such as CD3 antigen. In one embodiment, the binding domain comprises VL and VH derived form a monoclonal antibody to CD79b. Monoclonal antibodies to CD79b are known in the art. In one embodiment, the invention provides a chimeric polypeptide assembly composition comprising a first portion binding domain with binding affinity to the tumor-specific marker CD79b comprising anti-CD79b VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lxii) Anti-G250 Binding Domains

In some embodiments, the invention provides chimeric polypeptide assembly compositions comprising a first portion binding domain with binding affinity to the tumor-specific marker tumor-associated antigen G250 and a second binding domain binds to an effector cell antigen, such as CD3 antigen. In one embodiment, the binding domain comprises VL and VH derived form a monoclonal antibody to G250. Monoclonal antibodies to G250 are known in the art. In one embodiment, the invention provides a chimeric polypeptide assembly composition comprising a first portion binding domain with binding affinity to the tumor-specific marker G250 comprising anti-G250 VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lxiii) Anti-MT-MMPs Binding Domains

In some embodiments, the invention provides chimeric polypeptide assembly compositions comprising a first portion binding domain with binding affinity to the tumor-specific marker tumor-associated antigen MT-MMPs and a second binding domain binds to an effector cell antigen, such as CD3 antigen. In one embodiment, the binding domain comprises VL and VH derived form a monoclonal antibody to MT-MMPs. Monoclonal antibodies to MT-MMPs are known in the art. In one embodiment, the invention provides a chimeric polypeptide assembly composition comprising a first portion binding domain with binding affinity to the tumor-specific marker MT-MMPs comprising anti-MT-MMPs VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lxiv) Anti-F19 Antigen Binding Domains

In some embodiments, the invention provides chimeric polypeptide assembly compositions comprising a first portion binding domain with binding affinity to the tumor-specific marker tumor-associated antigen F19 antigen and a second binding domain binds to an effector cell antigen, such as CD3 antigen. In one embodiment, the binding domain comprises VL and VH derived form a monoclonal antibody to F19 antigen. Monoclonal antibodies to F19 antigen are known in the art. In one embodiment, the invention provides a chimeric polypeptide assembly composition comprising a first portion binding domain with binding affinity to the tumor-specific marker F19 antigen comprising anti-F19 antigen VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

(lxv) Anti-EphA2 Receptor Binding Domains

In some embodiments, the invention provides chimeric polypeptide assembly compositions comprising a first portion binding domain with binding affinity to the tumor-specific marker tumor-associated antigen EphA2 receptor and a second binding domain binds to an effector cell antigen, such as CD3 antigen. In one embodiment, the binding domain comprises VL and VH derived form a monoclonal antibody to EphA2 receptor. Monoclonal antibodies to EphA2 receptor are known in the art. In one embodiment, the invention provides a chimeric polypeptide assembly composition comprising a first portion binding domain with binding affinity to the tumor-specific marker EphA2 receptor comprising anti-EphA2 receptor VL and VH sequences. In another embodiment, the invention provides a chimeric polypeptide assembly composition comprising a first portion binding domain with binding affinity to the tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences. Preferably, in the embodiments, said binding has a $K_d$ value of greater than $10^{-7}$ to $10^{-10}$ M, as determined in an vitro binding assay.

It is specifically contemplated that the chimeric polypeptide assembly composition can comprise any one of the foregoing binding domains or sequence variants thereof so long as the variants exhibit binding specificity for the described antigen. In one embodiment, a sequence variant would be created by substitution of an amino acid in the VL or VH sequence with a different amino acid. In deletion variants, one or more amino acid residues in a VL or VH sequence as described herein are removed. Deletion variants, therefore, include all fragments of a binding domain polypeptide sequence. In substitution variants, one or more amino acid residues of a VL or VH (or CDR) polypeptide are removed and replaced with alternative residues. In one aspect, the substitutions are conservative in nature and conservative substitutions of this type are well known in the art. In addition, it is specifically contemplated that the compositions comprising the first and the second binding domains disclosed herein can be utilized in any of the methods disclosed herein.

2. Release Segment

In another aspect, the invention relates to chimeric polypeptide assembly compositions incorporating release segment (RS) peptide sequences capable of being cleaved by one or more mammalian proteases, wherein upon exposure of the RS to the protease (or proteases) the RS is cleaved and the bispecific binding domains are released from the composition. Upon release of the bispecific binding domains and the shielding bulking moiety of the subject chimeric polypeptide assembly compositions, the binding domains regain, due to the loss of the shielding effect of the bulking moiety, their full capacity to concurrently bind to an effector T cell and a cancer, tumor or target cell, resulting in damage or cytolysis of the cancer, tumor or target cell.

In certain embodiments, the invention provides chimeric polypeptide assembly composition compositions comprising a single fusion protein comprising a bifunctional binding domain portion, a binding moiety such as an XTEN, and an incorporated peptidic RS that is a substrate for one or more proteases associated with a target tissue, wherein the RS is recombinantly linked to the terminus of a bulking moiety, and the RS is recombinantly linked to a first portion comprising the first and the second binding domains; thus, the RS is located between the first portion and the XTEN or other bulking moiety.

In the embodiments the invention provides chimeric polypeptide assembly composition comprising one or more RS that are a substrate for a protease associated with a diseased target tissue in a subject; non-limiting examples of which are a cancer, tumor, or tissues or organs involved in a proliferative disorder or inflammatory disease. It is an object of the invention to provide RS specifically configured for use in chimeric polypeptide assembly compositions comprising bispecific binding domains such that the binding domains are released from the composition when the composition comprising the RS is in proximity with the targeted tissue-associated protease. The design of the chimeric polypeptide assembly compositions is such that the resulting released component comprising the binding domains have an enhanced ability to extravasate and to attach to or to penetrate into the target tissue; whether by the reduced molecular mass of the resulting fragment or by reduced steric hindrance by the flanking bulking moiety (e.g., XTEN) that is cleaved away.

Stroma in human carcinomas consists of extracellular matrix and various types of non-carcinoma cells such as leukocytes, endothelial cells, fibroblasts, and myofibroblasts. The tumor-associated stroma actively supports tumor growth by stimulating neo-angiogenesis, as well as proliferation and invasion of apposed carcinoma cells. Stromal fibroblasts, often referred to as cancer-associated fibroblasts (CAF), have a particularly important role in tumor progression due to their ability to dynamically modify the composition of the extracellular matrix (ECM), thereby facilitating tumor cell invasion and subsequent metastatic colonization. In particular, it is known in the art that proteases are important components that contribute to malignant progression, including tumor angiogenesis, invasion, extracellular matrix remodeling, and metastasis, where proteases function as part of an extensive multidirectional network of proteolytic interactions. As a requirement of malignant tumours is their ability to acquire a vasculature system in order to penetrate into surrounding normal tissues and disseminate to distant sites, the tumor relies heavily upon the increased expression of extracellular endoproteases from multiple enzymatic classes; e.g., the metalloproteases (MMP) and serine, threonine, cysteine and aspartic proteases. The role of proteases are not limited to tissue invasion and angiogenesis, however; these enzymes also have major roles in growth factor activation, cellular adhesion, cellular survival and immune surveillance. For example, MMPs are able to impact tumour cell behaviour as a consequence of their ability to cleave growth factors, cell surface receptors, cell adhesion molecules, or chemokines. Collectively, the actions of tumor-associated proteases represent a significant force in the phenotypic evolution of cancer.

As there is considerable evidence demonstrating differential expression of many such proteolytic enzymes between normal and tumour tissue, it is specifically contemplated that this differential expression can be utilized as a means to activate the subject compositions that are in proximity of a tumor. In this respect, the serine and metalloproteases, in particular, are candidates for targeted, differential drug delivery of the subject composition due to both their elevated activity in the extracellular tumour environment and their ability to selectively and specifically cleave the short peptide sequences of the RS, resulting in high levels of the active first portion of the subject composition at the tumour and low levels of intact chimeric polypeptide assembly composition in normal healthy tissues. As a consequence of the selective delivery of the chimeric polypeptide assembly composition, there is both a concomitant reduction in the required activity or dose of these agents and reduced toxicity against normal tissues, including liver, heart and bone marrow, thereby greatly improving the therapeutic index of the chimeric polypeptide assembly compositions. It is specifically contemplated that the disclosed compositions have the beneficial properties of this prodrug concept in that, amongst other properties, in the uncleaved state they exhibit reduced binding affinity for their respective ligands and they exhibit reduced extravasation in normal, healthy tissues, but upon cleavage are able to better extravasate, penetrate a tumor, and have higher binding affinity for their respective ligands; all of which contribute to an enhanced therapeutic index and reduced side effects of the subject compositions.

In some embodiments, the invention comprises chimeric polypeptide assembly compositions comprising RS wherein when the composition is cleaved by the targeted tissue-associated protease(s), releasing a fragment comprising the first portion binding domains, wherein the fragment is capable of penetrating within said targeted tissue, such as a tumor, to a concentration that is at least 2-fold, or at least 3-fold, or at least 4-fold, or at least 5-fold greater compared to the composition that is not cleaved. In other embodiments, the invention comprises chimeric polypeptide assembly compositions comprising RS wherein when the composition is cleaved by the targeted tissue-associated protease, releasing a fragment comprising the first portion binding domains, the fragment comprising the first portion binding domains is capable of penetrating within said tissue at a rate that is at least 2-fold, or at least 3-fold, or at least 4-fold, or at least 5-fold faster compared to the composition not comprising the RS. In one embodiment, the invention comprises a chimeric polypeptide assembly composition comprising RS wherein when the composition is cleaved by the targeted tissue-associated protease, releasing a fragment comprising the first portion binding domains, the cleaved first portion fragment has a resulting molecular weight that is at least 20% less, or at least 30% less, or at least 40% less, or at least 50% less, or at least 60% less, or at least 70% less, or at least 80% less than the intact chimeric polypeptide assembly composition that is not cleaved by the protease. In another embodiment, the invention comprises a chimeric polypeptide assembly composition comprising RS wherein when the composition is cleaved by the targeted tissue-associated protease, releasing a fragment comprising the first portion binding domains, the cleaved first portion fragment has a resulting hydrodynamic radius that is at least 20% less, or 30% less, or at least 40% less, or at least 50% less, or at least 60% less, or at least 70% less, or at least 80% less than the intact chimeric polypeptide assembly composition that is not cleaved by the protease. It is specifically contemplated that in the subject chimeric polypeptide assembly composition embodiments, the cleavage by the tissue-associated protease results in a fragment comprising the first portion binding domains that is able to more effectively penetrate the tissue, such as a tumor, because of the reduced size of the fragment relative to the intact composition, resulting in a pharmacologic effect known in the art for the combined binding domains within said tissue or cell, which may include damage to the membrane, induction of apoptosis, cytolysis or death of the target cell. It is also specifically contemplated that the RS of the chimeric polypeptide assembly compositions are designed for use in compositions intended to target specific tissues with a specific protease known to be produced by that target tissue or cell. In one embodiment, the RS comprises an amino acid sequence that is a substrate for a protease associated with a tissue that is a cancer. In another embodiment, the RS comprises an amino acid sequence that is a substrate for a protease associated with a cancerous tumor. In another embodiment, the RS comprises an amino acid sequence that is a substrate for a protease associated with a cancer such as a leukemia. In another embodiment, the RS comprises an amino acid sequence that is a substrate for a protease associated with a proliferative disorder. In another embodiment, the RS of the chimeric polypeptide assembly composition comprises an amino acid sequence that is a substrate for a protease associated with an inflammatory disease.

In some embodiments, the RS is a substrate for at least one protease selected from the group consisting of metalloproteinases, cysteine proteases, aspartate proteases, and serine proteases. In another embodiment, the RS is a substrate for one or more proteases selected from the group consisting of meprin, neprilysin (CD10), PSMA, BMP-1, A disintegrin and metalloproteinases (ADAMs), ADAMS, ADAMS, ADAM10, ADAM12, ADAM15, ADAM17 (TACE), ADAM19, ADAM28 (MDC-L), ADAM with thrombospondin motifs (ADAMTS), ADAMTS1, ADAMTS4, ADAMTS5, MMP-1 (Collagenase 1), MMP-2 (Gelatinase A), MMP-3 (Stromelysin 1), MMP-7 (Matrilysin 1), MMP-8 (Collagenase 2), MMP-9 (Gelatinase B), MMP-10 (Stromelysin 2), MMP-11 (Stromelysin 3), MMP-12 (Macrophage elastase), MMP-13 (Collagenase 3), MMP-14 (MT1-MMP), MMP-15 (MT2-MMP), MMP-19, MMP-23 (CA-MMP), MMP-24 (MT5-MMP), MMP-26 (Matrilysin 2), MMP-27 (CMMP), Legumain, Cathepsin B, Cathepsin C, Cathepsin K, Cathepsin L, Cathepsin S, Cathepsin X, Cathepsin D, Cathepsin E, Secretase, urokinase (uPA), Tissue-type plasminogen activator (tPA), plasmin, thrombin, prostate-specific antigen (PSA, KLK3), human neutrophil elastase (HNE), Elastase, Tryptase, Type II transmembrane serine proteases (TTSPs), DESC1, Hepsin (HPN), Matriptase, Matriptase-2, TMPRSS2, TMPRSS3, TMPRSS4 (CAP2), Fibroblast Activation Protein (FAP), kallikrein-related peptidase (KLK family), KLK4, KLK5, KLK6, KLK7, KLK8, KLK10, KLK11, KLK13, and KLK14. In some embodiments, the RS is a substrate for an ADAM17. In some embodiments, the RS is a substrate for a BMP-1. In some embodiments, the RS is a substrate for a cathepsin. In some embodiments, the RS is a substrate for a cysteine protease. In some embodiments, the RS is a substrate for a HtrA1. In some embodiments, the RS is a substrate for a legumain. In some embodiments, the RS is a substrate for a MT-SP1. In some embodiments, the RS is a substrate for a metalloproteinase. In some embodiments, the RS is a substrate for a neutrophil elastase. In some embodiments, the RS is a substrate for thrombin. In some embodiments, the RS is a substrate for a Type II transmembrane serine protease (TTSP). In some embodiments, the RS is a substrate for TMPRSS3. In some embodiments, the RS is a substrate for TMPRSS4. In some embodiments, the RS is a substrate for uPA. In one embodiment, the RS of the chimeric polypeptide assembly composition is a substrate for at least two proteases selected from the group consisting of MMP-2, MMP-9, uPA, and matriptase. In another embodiment, the RS of the chimeric polypeptide assembly composition is a substrate for MMP-2, MMP-9, uPA, and matriptase proteases.

In one embodiment, the RS of the chimeric polypeptide assembly composition comprises an amino acid sequence that is a substrate for an extracellular protease secreted by the target tissue, including but not limited to the proteases of Table 3. In another embodiment, the RS of the chimeric polypeptide assembly composition comprises an amino acid sequence that is a substrate for a cellular protease located within a cell, including but not limited to the proteases of Table 3.

In certain embodiments, the invention provides RS compositions intended for use in the subject chimeric polypeptide assembly compositions comprising at least a first cleavage sequence selected from the group of sequences set forth in Table 4. In some embodiments, the RS sequence of the subject compositions is selected from the group of sequences consisting of LSGRSDNHSPLGLAGS (SEQ ID NO: 1), SPLGLAGSLSGRSDNH (SEQ ID NO: 2), SPLGLSGRSDNH (SEQ ID NO: 3), LAGRSDNHSPLGLAGS (SEQ ID NO: 4), LSGRSDNHVPLSLKMG (SEQ ID NO: 5), SPLGLAGS (SEQ ID NO: 6), GPLALARG (SEQ ID NO: 7), LSGRSDNH (SEQ ID NO: 8), VPLSLTMG (SEQ ID NO: 9), VPLSLKMG (SEQ ID NO: 10), VPLSLSMG (SEQ ID NO: 11), EPLELVAG (SEQ ID NO: 12), EPLELRAG (SEQ ID NO: 13), EPAALMAG (SEQ ID NO: 14), EPASLMAG (SEQ ID NO: 15), RIGSLRTA (SEQ ID NO: 16), RIQFLRTA (SEQ ID NO: 17), EPFHLMAG (SEQ ID NO: 18), VPLSLFMG (SEQ ID NO: 19), EPLELPAG (SEQ ID NO: 20), and EPLELAAG (SEQ ID NO: 21). Where desired, the RS sequence of the subject chimeric polypeptide assembly composition is LSGRSDNHSPLGLAGS (SEQ ID NO: 1). In one embodiment, the RS of the chimeric polypeptide assembly composition comprises the sequence of BSRS1 of Table 4. In another embodiment, the RS of the chimeric polypeptide assembly composition consists of the sequence of BSRS1 of Table 4.

In another embodiment, the RS of the cleavage conjugate composition comprises a first cleavage sequence and a second cleavage sequence different from said first cleavage sequence wherein each sequence is selected from the group of sequences set forth in Table 4 and the first and the second cleavage sequences are linked to each other by 1 to 6 amino acids selected from glycine, serine, alanine, and threonine. In another embodiment, the RS of the cleavage conjugate composition comprises a first cleavage sequence, a second cleavage sequence different from said first cleavage sequence, and a third cleavage sequence wherein each sequence is selected from the group of sequences set forth in Table 4 and the first and the second and the third cleavage sequences are linked to each other by 1 to 6 amino acids selected from glycine, serine, alanine, and threonine. In other embodiments, the invention provides chimeric polypeptide assembly compositions comprising one, two, or three RS It is specifically intended that the multiple RS of the chimeric polypeptide assembly compositions can be concatenated to form a universal sequence that can be cleaved by multiple proteases. It is contemplated that such compositions would be more readily cleaved by diseased target tissues that express multiple proteases, with the result that the resulting fragments bearing the binding domains would more readily penetrate the target tissue and exert the pharmacologic effect of the binding domains.

TABLE 3

Proteases of Target Tissues.

| Class of Proteases | Protease |
| --- | --- |
| Metalloproteinases | Meprin |
| | Neprilysin (CD10) |
| | PSMA |
| | BMP-1 |
| | A disintegrin and metalloproteinases (ADAMs) |
| | ADAM8 |
| | ADAM9 |
| | ADAM10 |
| | ADAM12 |
| | ADAM15 |
| | ADAM17 (TACE) |
| | ADAM19 |
| | ADAM28 (MDC-L) |
| | ADAM with thrombospondin motifs (ADAMTS) |
| | ADAMTS1 |
| | ADAMTS4 |
| | ADAMTS5 |
| | Matrix Metalloproteinases (MMPs) |
| | MMP-1 (Collagenase 1) |
| | MMP-2 (Gelatinase A) |
| | MMP-3 (Stromelysin 1) |
| | MMP-7 (Matrilysin 1) |
| | MMP-8 (Collagenase 2) |
| | MMP-9 (Gelatinase B) |
| | MMP-10 (Stromelysin 2) |
| | MMP-11 (Stromelysin 3) |
| | MMP-12 (Macrophage elastase) |
| | MMP-13 (Collagenase 3) |
| | MMP-14 (MT1-MMP) |
| | MMP-15 (MT2-MMP) |
| | MMP-19 |
| | MMP-23 (CA-MMP) |
| | MMP-24 (MT5-MMP) |
| | MMP-26 (Matrilysin 2) |
| | MMP-27 (CMMP) |
| Cysteine Proteases | Legumain |
| | Cysteine Cathepsins |
| | Cathepsin B |
| | Cathepsin C |
| | Cathepsin K |
| | Cathepsin L |
| | Cathepsin S |
| | Cathespin X |
| Aspartate Proteases | Cathepsin D |
| | Cathepsin E |
| | Secretase |
| Serine Proteases | Urokinase (uPA) |
| | Tissue-type plasminogen activator (tPA) |
| | Plasmin |
| | Thrombin |
| | Prostate-specific antigen (PSA, KLK3) |
| | Human neutrophil elastase (HNE) |
| | Elastase |
| | Tryptase |
| | Type II transmembrane serine proteases (TTSPs) |
| | DESC1 |
| | Hepsin (HPN) |
| | Matriptase |
| | Matriptase-2 |
| | TMPRSS2 |
| | TMPRSS3 |
| | TMPRSS4 (CAP2) |
| | Fibroblast Activation Protein (FAP) |
| | kallikrein-related peptidase (KLK family) |
| | KLK4 |
| | KLK5 |
| | KLK6 |
| | KLK7 |
| | KLK8 |
| | KLK10 |
| | KLK11 |
| | KLK13 |
| | KLK14 |

TABLE 4

Sequences of Release Segments (RS)

| RS Designation | Protease Acting Upon Sequence | Exemplary Cleavage Sequence | SEQ ID NO: | Cleavage Sequences* | SEQ ID NO: |
| --- | --- | --- | --- | --- | --- |
| BSRS1 | MMP-2, 7, 9, 14, matriptase, uPA, legumain | LSGR↓SDN↓HSPLG↓LAGS | 243 | | |
| BSRS2 | MMP-2, 7, 9, 14, matriptase, uPA, legumain | SPLG↓LAGSLSGR↓SDN↓H | 244 | | |
| BSRS3 | MMP-2, 7, 9, 14, matriptase, uPA, legumain | SPLG↓LSGR↓SDN↓H | 245 | | |
| BSRS4 | MMP-2, 7, 9, 14, matriptase, uPA, legumain | LAGR↓SDN↓HSPLG↓LAGS | 246 | | |
| BSRS5 | MMP-2, 7, 9, 14, matriptase, uPA, legumain | LAGR↓SDN↓HVPLS↓LSMG | 247 | | |
| BSRS6 | MMP-2, 7, 9, 14, matriptase, uPA, legumain | LAGR↓SDN↓HEPLE↓LVAG | 248 | | |

TABLE 4-continued

Sequences of Release Segments (RS)

| RS Designation | Protease Acting Upon Sequence | Exemplary Cleavage Sequence | SEQ ID NO: | Cleavage Sequences* | SEQ ID NO: |
|---|---|---|---|---|---|
| BRSS7 | MMP-2, 7, 9, 14, matriptase, uPA, legumain | LSGR↓SDN↓HVPLS↓LK↓MG | 249 | | |
| RS1 | MMP-2, 7, 9, 14 | SPLG↓LAGS | 250 | | |
| RS2 | MMP-2, 7, 9, 14, matriptase, uPA, legumain | GPLG↓LAR↓G | 251 | | |
| RS3 | Matriptase, uPA, legumain | LSGR↓SDN↓H | 252 | | |
| RS4 | MMP-2, 14 | GTAW↓LMGG | 253 | | |
| RS5 | MMP-14 | RIGS↓LRTA | 254 | | |
| RS6 | MMP-14 | RIGA↓LRTA | 255 | | |
| RS7 | MMP-14 | RIGW↓LRTA | 256 | | |
| RS8 | MMP-14 | RIGN↓LRTA | 257 | | |
| RS9 | MMP-14 | RIGF↓LRTA | 258 | | |
| RS10 | MMP-14 | RIFF↓LRTA | 259 | | |
| RS11 | MMP-14 | RILF↓LRTA | 260 | | |
| RS12 | MMP-14 | RIYF↓LRTA | 261 | | |
| RS13 | MMP-14 | RIQF↓LRTA | 262 | | |
| RS14 | MMP-14 | EPAA↓LMAG | 263 | | |
| RS15 | MMP-14 | EPAN↓LMAG | 264 | | |
| RS16 | MMP-14 | EPAS↓LMAG | 265 | | |
| RS17 | MMP-14 | EPFH↓LMAG | 266 | | |
| RS18 | MMP-14 | EPWW↓LMAG | 267 | | |
| RS19 | MMP-14 | EPRW↓LMAG | 268 | | |
| RS20 | MMP-7 | VPLS↓LFMG | 269 | | |
| RS21 | MMP-7 | VPLS↓LHMG | 270 | | |
| RS22 | MMP-7 | VPLS↓LQAG | 271 | | |
| RS23 | MMP-2, 7, 9, 14 | VPLS↓LTMG | 272 | | |
| RS24 | MMP-2, 7, 9, 14, matriptase | VPLS↓LKMG | 273 | | |
| RS25 | MMP-2, 7, 9, 14 | VPLS↓LSMG | 274 | | |
| RS26 | MMP-7 | VPLS↓LNAG | 275 | | |
| RS27 | MMP-7 | VPLS↓LLMG | 276 | | |
| RS28 | MMP-7 | EPLE↓LPAG | 277 | | |
| RS29 | MMP-2, 7, 9, 14 | EPLE↓LAAG | 278 | | |
| RS30 | MMP-2, 7, 9 | EPLE↓LVAG | 279 | | |
| RS31 | MMP-7 | EPLE↓LSAG | 280 | | |

TABLE 4-continued

Sequences of Release Segments (RS)

| RS Designation | Protease Acting Upon Sequence | Exemplary Cleavage Sequence | SEQ ID NO: | Cleavage Sequences* | SEQ ID NO: |
|---|---|---|---|---|---|
| RS32 | MMP-7 | EPLE↓LDAG | 281 | | |
| RS33 | MMP-7 | EPLE↓LQAG | 282 | | |
| RS34 | MMP-2, 7, 9, 14, matriptase | EPLE↓LRAG | 283 | | |
| RS35 | MMP-7 | EPLE↓LKAG | 284 | | |
| RS36 | MMP-2, 7, 9, 14 | EPLE↓LIAG | 285 | | |
| RS37 | Elastase-2 | LGPV↓SGVP | 286 | —/—/—/VIAT/—/—/—/— | |
| RS38 | Granzyme-B | VAGD↓SLEE | 287 | V/—/—/D/—/—/—/— | |
| RS39 | MMP-12 | GPAG↓LGGA | 288 | G/PA/—/G/L/—/G/— | 359 |
| RS40 | MMP-13 | GPAG↓LRGA | 289 | G/P/—/G/L/—/GA/— | 360 |
| RS41 | MMP-17 | APLG↓LRLR | 290 | —/PS/—/—/LQ/—/LT/— | |
| RS42 | MMP-20 | PALP↓LVAQ | 291 | | |
| RS43 | TEV | ENLFQ↓G | 292 | E/N/L/Y/F/Q/GS | 361 |
| RS44 | Enterokinase | DDDK↓IVGG | 293 | | |
| RS45 | Protease 3C (PreScission ™) | LEVLFQ↓GP | 294 | | |
| RS46 | Sortase A | LPKT↓GSES | 295 | L/P/KEAD/T/G/—/EKS/S | 362 |
| RS47 | Trypsin | K↓X** or R↓X | | K/X or R/X | |
| RS48 | Trypsin | R↓X** | | SASRSA | 363 |
| RS49 | uPA | SGR↓SA | 296 | S/G/R/SRKA/AG SVR | 364 |
| RS50 | tPA | YGR↓SA | 297 | RYFLI/GA/R/RV AS/AG | |
| RS51 | PSA | SSYY↓SG | 298 | S/S/FY/Y/S/G | 365 |
| RS52 | DESC1 | RRAR↓VVGG | 299 | R/RAL/ALY/R/A/V/V/G/G | 366 |
| RS53 | Hepsin | RQLR↓VVGG | 300 | R/RQ/YL/R/V/V/G/G | 367 |
| RS54 | Matriptase-2 | RRAR↓VVGG | 299 | R/R/A/R/AV/V/G/G | 368 |
| RS55 | MT-SP1/Matriptase | RQAR↓VVGG | 301 | R/QR/A/R/AVY/V/G/G | 369 |
| RS56 | PSMA | N↓γN | | NγN | |
| RS57 | Cathepsin C | GF↓FY | 302 | GP/FWR/X/— | |
| RS58 | Cathepsin D | F↓IK | | FL/IV/KE | |
| RS59 | Cathepsin E | F↓IK | | FL/IV/KE | |
| RS60 | Cathepsin F | WLR↓ | | WYRNle/L/RKQ | |
| RS61 | Cathepsin K | KPR↓ | | KMGH/ILPNle/R KQ | |
| RS62 | Cathepsin L | KFR↓ | | RKLnL/FYW/RKQ | |
| RS63 | Cathepsin S | RVK↓ | | RPI/VLMnL/RKQ | |

TABLE 4-continued

Sequences of Release Segments (RS)

| RS Designation | Protease Acting Upon Sequence | Exemplary Cleavage Sequence | SEQ ID NO: | Cleavage Sequences* | SEQ ID NO: |
|---|---|---|---|---|---|
| RS64 | Cathepsin V/L2 | PWR↓ | | PNleR/WYF/RKQ | |
| RS65 | MMP | PLGHofOrnL | 303 | | |
| RS66 | MMP | EPCitF↓HofYL | 304 | | |
| RS67 | MMP-2 | PQG↓AGQ | 305 | | |
| RS68 | MMP-2 | PQG↓MelG | 306 | | |
| RS69 | MMP-9 | AALG↓NvaP | 307 | | |
| RS70 | MMP-9 | GPQG↓IAGQR | 308 | | |
| RS71 | MMP-9 | SGKIPRT↓ATA | 309 | S/G/K/I/P/R/PSTR A/Hy/ST/A | 370 |
| RS72 | MMP-9 | SGPLF↓YSVTA | 310 | | |
| RS73 | MMP-9 | PLR↓LSW | 311 | | |
| RS74 | MMP-9 | GKGPRQ↓ITA | 312 | | |
| RS75 | MMP-9 | SGRR↓LIHHT | 313 | S/G/R/R/L/IL/H/H/T | 371 |
| RS76 | MMP-9 | SGQPHY↓LTTA | 314 | | |
| RS77 | MMP-9 | SG↓LKALM | 315 | | |
| RS78 | MMP-9 | SGFGSRY↓LTA | 316 | | |
| RS79 | MMP-9 | SGLRPAK↓STA | 317 | | |
| RS80 | MMP-9 | LGP↓STST | 318 | | |
| RS81 | MMP-9 | PQG↓NR | 319 | | |
| RS82 | MMP-9 | PSG↓LP | 320 | P/S/G/L/HyP | 372 |
| RS83 | MMP-9 | PAG↓NQ | 321 | | |
| RS84 | MMP-9 | PSG↓RD | 322 | | |
| RS85 | MMP-9 | PPG↓IV | 323 | P/PG/G/Hy/HyR | |
| RS86 | MMP-9 | PEN↓FF | 324 | | |
| RS87 | MMP-9 | PLK↓LM | 325 | | |
| RS88 | MMP-9 | PGA↓YH | 326 | | |
| RS89 | MMP-9 | AIH↓IQ | 327 | | |
| RS90 | MMP-9 | HFF↓KN | 328 | | |
| RS91 | MMP-9 | GLS↓LS | 329 | | |
| RS92 | MMP-9 | ASD↓YK | 330 | | |
| RS93 | MMP-2, MMP-9 | GPLG↓MLSQ | 331 | | |
| RS94 | MMP-2, MMP-9 | CG↓LDD | 332 | | |
| RS95 | MMP-2, MMP-9, MT1-MMP | GPQG↓IWGQ | 333 | | |
| RS96 | MMP-7 | RPLA↓LWRS | 334 | | |
| RS97 | MMP-7 | GPLG↓LARK | 335 | | |

TABLE 4-continued

Sequences of Release Segments (RS)

| RS Designation | Protease Acting Upon Sequence | Exemplary Cleavage Sequence | SEQ ID NO: | Cleavage Sequences* | SEQ ID NO: |
|---|---|---|---|---|---|
| RS98 | Hk2 | GKAFR↓RL | 336 | | |
| RS99 | MMP-9, uPA | RPSA↓SRSA | 337 | | |
| RS100 | MMP-2 | PLGLDpaAR | 338 | | |
| RS101 | MMP-9 | PMG↓IST | 339 | P/LMVQChaHof Nva/G/LIYSFC/ST | |
| RS102 | MMP-9 | PChaG↓SmcHA | 340 | P/LCha/G/LSmc/ HW/A | |
| RS103 | MMP-13, MMP-8 | PChaGNvaHADpa | 341 | | |
| RS104 | ADAM10 | PTASA↓LKG | 342 | P/T/A/AS/A/LFY Q/KRTI/GAS | 373 |
| RS105 | ADAM17 | PRPAA↓VKGT | 343 | P/HR/P/AS/A/VIL/ KRTVI/GST/TP | |
| RS106 | Cathepsin B | V↓Cit | | | |
| RS107 | Cathepsin B | F↓K | | | |
| RS108 | Elastase | AA↓PV | 344 | | |
| RS109 | Cathepsin D | GPIC↓FRLG | 345 | | |
| RS110 | Plasmin | A↓FK | | | |
| RS111 | Legumain | AAN↓L | 346 | | |
| RS112 | Legumain | PTN↓ | | PTAWS/TPASI/N | |
| RS113 | Meprin | ↓DGP | | ED/GTAV/— | |
| RS114 | Meprin A | F↓SPFR | 347 | SFAMTY/ SFAMTY/P/PVI GA/— | |
| RS115 | Meprin B | E↓EEAY | 348 | DE/DE/YEFDG/P VIGA/— | |
| RS116 | Neprilysin | β-AIA↓L | 349 | β-A/LI/A/L | |
| RS117 | ADAMTS4 | E↓VQRKTGT | 350 | E/AFVLMY/(—)/ RK/—(—)/ST | |
| RS118 | ADAMTS4 | DVQE↓FRGVTAVIR | 351 | | |
| RS119 | ADAMTS4 | HNE↓FRQRETYMVF | 352 | | |
| RS120 | ADAMTS5 | KEEE↓GLGS | 353 | | |
| RS121 | ADAMTS5 | GELE↓GRGT | 354 | | |
| RS122 | ADAMTS5 | NITEGE↓ARGS | 355 | | |

TABLE 4-continued

Sequences of Release Segments (RS)

| RS Designation | Protease Acting Upon Sequence | Exemplary Cleavage Sequence | SEQ ID NO: | Cleavage Sequences* | SEQ ID NO: |
|---|---|---|---|---|---|
| RS123 | ADAMTS5 | TAQE↓AGEG | 356 | | |
| RS124 | ADAMTS5 | VSQE↓LGQR | 357 | | |
| RS125 | ADAMTS5 | PTAQE↓AGE | 358 | | |

↓ indicates cleavage site
Special amino acid abbreviation:
Cit: Citrilline;
Cha: β-cyclohexylalanine;
Hof: homophenylalanine;
Nva: aminosuberic acid;
Dpa: D-phenylalanine;
Nle: Norleucine;
Smc: S-methylcysteine;
MnL: methylnorleucine;
Mel: Melphalan.
*the listing of multiple amino acids before, between, or after a slash indicate alternative amino acids that can be substituted at the position; "−" indicates that any amino acid may be substituted for the corresponding amino acid indicated in the middle column
**x is any L-amino acid other than proline
Hy is any hydrophobic L-amino acid
γ indicates that bond is a gamma carboxy linkage 3. Bulking Moiety In another aspect, the instant invention relates to chimeric polypeptide assembly compositions comprising at least a first bulking moiety. In some embodiments, the invention provides a chimeric polypeptide assembly compositions comprising a bulking moiety. Non-limiting examples of bulking moieties include extended recombinant polypeptide (XTEN, as described herein, below); albumin binding domain; albumin; IgG binding domain; polypeptides of at least 350 amino acid residues consisting of proline, serine, and alanine; fatty acid; elastin-like protein (ELP) (the individual subunit or building blocks of ELPs are derived from a five amino acid motif found in human protein elastin that is repeated multiple times to form the ELP biopolymer, as described in WO2016081884), Fc domain, polyethylene glycol (PEG), PLGA, and hydroxyethyl starch. In another embodiment, the bulking moiety comprises two different bulking moieties selected from the group consisting of XTEN; albumin binding domain; albumin; IgG binding domain; polypeptides consisting of proline, serine, and alanine; fatty acid; Fc domain, polyethylene glycol (PEG), PLGA, and hydroxyethyl starch, wherein the two bulking moieties are linked to each other and, in turn, to the release segment of the composition. In a preferred embodiment, the bulking moiety of the subject compositions is one or more molecules of XTEN. In another preferred embodiment, the chimeric polypeptide assembly compositions comprise a bulking moiety sequence having at least 90%, 91%, 92%, 93%, 94%, 95%, 96%, 97%, 98%, 99%, or 100% sequence identity to an XTEN sequence of comparable length selected from the group of sequences set forth in Table 5. In the embodiments, the XTEN polypeptides linked recombinantly to the second portion release segment(s) (RS) of the compositions.

Without being bound by theory, the incorporation of the bulking moiety was incorporated into the design of the subject compositions to confer certain important properties; 1) provide chimeric polypeptide assembly compositions with a bulking moiety that shields the binding domains and reduces binding affinity for the target antigens and effector cell antigens when the composition is intact, ii) provide chimeric polypeptide assembly compositions with a bulking moiety that provides enhanced half-life when administered to a subject, iii) provide chimeric polypeptide assembly compositions with a bulking moiety that reduces extravasation in normal tissues and organs yet permits a degree of extravasation in diseased tissues (e.g., a tumor) with larger pore sizes in the vasculature, yet could be released from the composition by action of certain mammalian proteases, thereby permitting the binding domains of the composition to more readily penetrate into the diseased tissues and to concurrently bind the target antigens on the effector cell and tumor cell. To meet these needs, the invention provides chimeric polypeptide assembly compositions in which the bulking moiety provides increased mass and hydrodynamic radius to the resulting composition. In preferred embodiments, the bulking moiety is an XTEN polypeptide, which provides certain advantages in the design of the subject compositions in that is provides not only provides increased mass and hydrodynamic radius, but its flexible, unstructured characteristics provides a shielding effect over the binding domains of first portion of the composition, thereby reducing the likelihood of binding to antigens in normal tissues or the vasculature of normal tissues that don't express or express reduced levels of target antigens and/or effector cell antigens, and enhances solubility and proper folding of the scFv.

(i) XTEN

In certain embodiments, the invention provides chimeric polypeptide assembly compositions comprising one or more molecules of an XTEN linked recombinantly to the composition.

"XTEN" as used herein, are polypeptides with non-naturally occurring, substantially non-repetitive sequences having a low degree or no secondary or tertiary structure under physiologic conditions, as well as additional properties described in the paragraphs that follow. XTEN typically have from at least about 100 to at least about 1000 or more amino acids, and more preferably at least about 200 to at least about 900 amino acids, and more preferably at least about 400 to about 866 amino acids of which the majority or the entirety are small hydrophilic amino acids. As used herein, XTEN specifically excludes whole antibodies or antibody fragments (e.g. single-chain antibodies and Fc fragments). XTEN polypeptides have utility as fusion partners in that they serve in various roles, conferring certain desirable properties when linked to a composition comprising, for example, the first portion bispecific binding domains of the subject chimeric polypeptide assembly compositions described herein. The resulting compositions have enhanced properties, such as enhanced pharmacokinetic, physicochemical, pharmacologic, and improved toxicological and pharmaceutical properties compared to the corresponding binding domains not linked to XTEN, making them useful in the treatment of certain conditions for which the binding domains are known in the art to be used.

The unstructured characteristic and physicochemical properties of the XTEN result, in part, from the overall amino acid composition that is disproportionately limited to 4-6 types of hydrophilic amino acids, the linking of the amino acids in a quantifiable, substantially non-repetitive design, and from the resulting length and/or configuration of the XTEN polypeptide. In an advantageous feature common to XTEN but uncommon to native polypeptides, the properties of XTEN disclosed herein are not tied to absolute primary amino acid sequences, as evidenced by the diversity of the exemplary sequences of Table 5 that, within varying ranges of length, possess similar properties and confer enhanced properties on the compositions to which they are linked, many of which are documented in the Examples. Indeed, it is specifically contemplated that the compositions of the invention not be limited to those XTEN specifically enumerated in Table 5, but, rather, the embodiments include sequences having at least 90%, 91%, 92%, 93%, 94%, 95%, 96%, 97%, 98%, or 99% sequence identity to the sequences of Table 5 as they exhibit the properties of XTEN described below. It has been established that such XTEN have properties more like non-proteinaceous, hydrophilic polymers (such as polyethylene glycol, or "PEG") than they do proteins. The XTEN of the present invention exhibit one or more of the following advantageous properties: defined and uniform length (for a given sequence), conformational flexibility, reduced or lack of secondary structure, high degree of random coil formation, high degree of aqueous solubility, high degree of protease resistance, low immunogenicity, low binding to mammalian receptors, a defined degree of charge, and increased hydrodynamic (or Stokes) radii; properties that are similar to certain hydrophilic polymers (e.g., polyethylene glycol) that make them particularly useful as fusion partners.

The XTEN component(s) of the subject fusion proteins are designed to behave like denatured peptide sequences under physiological conditions, despite the extended length of the polymer. "Denatured" describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some embodiments, the invention provides chimeric polypeptide assembly compositions that comprise XTEN sequences that, under physiologic conditions, resemble denatured sequences that are substantially devoid of secondary structure under physiologic conditions. "Substantially devoid," as used in this context, means that at least about 80%, or about 90%, or about 95%, or about 97%, or at least about 99% of the XTEN amino acid residues of the XTEN sequence do not contribute to secondary structure, as measured or determined by the methods described herein, including algorithms or spectrophotometric assays.

A variety of well-established methods and assays are known in the art for determining and confirming the physicochemical properties of the subject XTEN. Such properties include but are not limited to secondary or tertiary structure, solubility, protein aggregation, stability, absolute and apparent molecular weight, purity and uniformity, melting properties, contamination and water content. The methods to measure such properties include analytical centrifugation, EPR, HPLC-ion exchange, HPLC-size exclusion chromatography (SEC), HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra, as does the lack of these structure elements. Secondary structure can also be predicted for a polypeptide sequence via certain computer programs or algorithms, such as the well-known Chou-Fasman algorithm (Chou, P. Y., et al. (1974) *Biochemistry*, 13: 222-45) and the Garnier-Osguthorpe-Robson algorithm ("Gor algorithm") (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure). Polypeptide sequences can be analyzed using the Chou-Fasman algorithm using sites on the world wide web at, for example, fasta.bioch.virginia.edu/fasta_www2/ fasta_www.cgi?rm=misc1 and the Gor algorithm at npsa-pbil.ibcp.fr/cgi-bin/npsa_automat.pl?page=npsa_gor4.html (both accessed on Sep. 5, 2012). Random coil can be determined by a variety of methods, including by using intrinsic viscosity measurements, which scale with chain length in a conformation-dependent way (Tanford, C., Kawahara, K. & Lapanje, S. (1966) J. Biol. Chem. 241, 1921-1923), as well as by size-exclusion chromatography (Squire, P. G., Calculation of hydrodynamic parameters of random coil polymers from size exclusion chromatography and comparison with parameters by conventional methods. Journal of Chromatography, 1981, 5, 433-442). Additional methods are disclosed in Arnau, et al., Prot Expr and Purif (2006) 48, 1-13.

In one embodiment, the XTEN sequences of the chimeric polypeptide assembly compositions have an alpha-helix percentage ranging from 0% to less than about 5% and a beta-sheet percentage ranging from 0% to less than about 5% as determined by the Chou-Fasman algorithm and at least about 90% random coil formation as determined by the GOR algorithm. In another embodiment, the XTEN sequences of the disclosed compositions have an alpha-helix percentage less than about 2% and a beta-sheet percentage less than about 2% as determined by the Chou-Fasman algorithm and at least about 90% random coil formation as determined by the GOR algorithm. In another embodiment, the XTEN sequences of the compositions are substantially lacking secondary structure as measured by circular dichroism.

It has been established that the non-repetitive characteristic of XTEN employed in the subject compositions of the present invention together with the particular types of amino acids that predominate in the XTEN, rather than the absolute primary sequence, confers one or more of the enhanced physicochemical and biological properties of the XTEN and the resulting chimeric polypeptide assembly compositions. Accordingly, while the sequences of Table 5 are exemplary, they are not intended to be limiting as sequences having at least 90%, 91%, 92%, 93%, 94%, 95%, 96%, 97%, 98%, or 99% sequence identity to the sequences of Table 5 exhibit the enhanced properties of XTEN. These enhanced properties include a high degree of expression of the chimeric polypeptide assembly compositions fusion protein in the host cell, greater genetic stability of the gene encoding the XTEN portion of the subject compositions, XTEN confers a greater degree of solubility on the resulting chimeric polypeptide assembly compositions with less tendency to aggregate, and enhanced pharmacokinetics of the resulting chimeric polypeptide assembly compositions compared to binding domains not linked to XTEN. These enhanced properties permit more efficient manufacturing, greater uniformity of the final product, lower cost of goods, and/or facilitate the formulation of pharmaceutical preparations containing extremely high protein concentrations of chimeric polypeptide assembly composition, in some cases exceeding 100 mg/ml, as well as an improved safety profile and reduced dosing interval, described more fully below, of the resulting compositions.

In some embodiments, the XTEN sequence used in the chimeric polypeptide assembly compositions of the invention is at least 90%, 91%, 92%, 93%, 94%, 95%, 96%, 97%, 98%, 99%, or 100% identical to a sequence selected from the group consisting of AE144, AE144_1A, AE144_2A, AE144_2B, AE144_3A, AE144_3B, AE144_4A, AE144_4B, AE144_5A, AE144_6B, AE288_1, AE288_2, AE144A, AE144B, AE180A, AE216A, AE252A, AE288A, AE324A, AE360A, AE396A, AE432A, AE468A, AE504A, AE540A, AE576A, AE612A, AE648A, AE684A, AE720A, AE756A, AE792A, AE828A, AE869, AE144_R1, AE288_R1, AE432_R1, AE576_R1, AE864_R1, AE712, AE864_R2, AE912, AM923, AE948, AE1044, AE1140, AE1236, AE1332, AE1428, AE1524, AE1620, AE1716, AE1812, AE1908, AE2004A, and any combination thereof. See US 2010-0239554 A1. In one particular embodiment, the XTEN comprises a sequence selected from AE144, AE288, AE576, AE864, AE865, or AE866, or any combination thereof.

In some embodiments, wherein less than 100% of amino acids of an XTEN in the chimeric polypeptide assembly compositions are selected from glycine (G), alanine (A), serine (S), threonine (T), glutamate (E) and proline (P), or wherein less than 100% of the sequence consists of the XTEN sequences of Table 5, the remaining amino acid residues of the XTEN are selected from any of the other 14 natural L-amino acids, but are preferably selected from hydrophilic amino acids such that the XTEN sequence contains at least about 90%, 91%, 92%, 93%, 94%, 95%, 96%, 97%, 98%, or at least about 99% hydrophilic amino acids. The content of hydrophobic amino acids in the XTEN utilized in the chimeric polypeptide assembly compositions can be less than 5%, or less than 2%, or less than 1% hydrophobic amino acid content. Hydrophobic residues that are less favored in construction of XTEN include tryptophan, phenylalanine, tyrosine, leucine, isoleucine, valine, and methionine. Additionally, XTEN sequences can contain less than 5% or less than 4% or less than 3% or less than 2% or less than 1% or none of the following amino acids: methionine (for example, to avoid oxidation), or asparagine and glutamine (to avoid desamidation).

The amino acid sequences for certain XTEN sequences utilized in the chimeric polypeptide assembly embodiments of the invention are shown in Table 5.

TABLE 5

XTEN Polypeptides

| XTEN Name | Amino Acid Sequence | SEQ ID NO: |
| --- | --- | --- |
| AE144 | GSEPATSGSETPGTSESATPESGPGSEPATSGSETPGSPAGSPTSTEEGT STEPSEGSAPGSEPATSGSETPGSEPATSGSETPGSEPATSGSETPGTST EPSEGSAPGTSESATPESGPGSEPATSGSETPGTSTEPSEGSAP | 374 |
| AE144_1A | SPAGSPTSTEEGTSESATPESGPGTSTEPSEGSAPGSPAGSPTSTEEGTS TEPSEGSAPGTSTEPSEGSAPGTSESATPESGPGSEPATSGSETPGSEPA TSGSETPGSPAGSPTSTEEGTSESATPESGPGTSTEPSEGSAPG | 375 |
| AE144_2A | TSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTE PSEGSAPGTSTEPSEGSAPGTSESATPESGPGTSESATPESGPG | 376 |
| AE144_2B | TSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTE PSEGSAPGTSTEPSEGSAPGTSESATPESGPGTSESATPESGPG | 376 |
| AE144_3A | SPAGSPTSTEEGTSESATPESGPGSEPATSGSETPGTSESATPESGPGTS TEPSEGSAPGTSTEPSEGSAPGTSTEPSEGSAPGTSTEPSEGSAPGTSTE PSEGSAPGTSTEPSEGSAPGSPAGSPTSTEEGTSTEPSEGSAPG | 377 |
| AE144_3B | SPAGSPTSTEEGTSESATPESGPGSEPATSGSETPGTSESATPESGPGTS TEPSEGSAPGTSTEPSEGSAPGTSTEPSEGSAPGTSTEPSEGSAPGTSTE PSEGSAPGTSTEPSEGSAPGSPAGSPTSTEEGTSTEPSEGSAPG | 377 |

TABLE 5-continued

XTEN Polypeptides

| XTEN Name | Amino Acid Sequence | SEQ ID NO: |
|---|---|---|
| AE144_4A | TSESATPESGPGSEPATSGSETPGTSESATPESGPGSEPATSGSETPGTS ESATPESGPGTSTEPSEGSAPGTSESATPESGPGSPAGSPTSTEEGSPAG SPTSTEEGSPAGSPTSTEEGTSESATPESGPGTSTEPSEGSAPG | 378 |
| AE144_4B | TSESATPESGPGSEPATSGSETPGTSESATPESGPGSEPATSGSETPGTS ESATPESGPGTSTEPSEGSAPGTSESATPESGPGSPAGSPTSTEEGSPAG SPTSTEEGSPAGSPTSTEEGTSESATPESGPGTSTEPSEGSAPG | 378 |
| AE144_5A | TSESATPESGPGSEPATSGSETPGTSESATPESGPGSEPATSGSETPGTS ESATPESGPGTSTEPSEGSAPGSPAGSPTSTEEGTSESATPESGPGSEPA TSGSETPGTSESATPESGPGSPAGSPTSTEEGSPAGSPTSTEEG | 379 |
| AE144_6B | TSTEPSEGSAPGTSESATPESGPGTSESATPESGPGTSESATPESGPGSEP ATSGSETPGSEPATSGSETPGSPAGSPTSTEEGTSTEPSEGSAPGTSTEP SEGSAPGSEPATSGSETPGTSESATPESGPGTSTEPSEGSAPG | 380 |
| AE288_1 | GTSESATPESGPGSEPATSGSETPGTSESATPESGPGSEPATSGSETPGT SESATPESGPGTSTEPSEGSAPGSPAGSPTSTEEGTSESATPESGPGSE ATSGSETPGTSESATPESGPGSPAGSPTSTEEGSPAGSPTSTEEGTSTEP SEGSAPGTSESATPESGPGTSESATPESGPGTSESATPESGPGSEPATSG SETPGSEPATSGSETPGSPAGSPTSTEEGTSTEPSEGSAPGTSTEPSEGS APGSEPATSGSETPGTSESATPESGPGTSTEPSEGSAP | 381 |
| AE288_2 | GSPAGSPTSTEEGTSESATPESGPGSEPATSGSETPGTSESATPESGPGT STEPSEGSAPGTSTEPSEGSAPGTSTEPSEGSAPGTSTEPSEGSAPGTST EPSEGSAPGTSTEPSEGSAPGSPAGSPTSTEEGTSTEPSEGSAPGTSESA TPESGPGSEPATSGSETPGTSESATPESGPGSEPATSGSETPGTSESATP ESGPGTSTEPSEGSAPGTSESATPESGPGSPAGSPTSTEEGSPAGSPTST EEGSPAGSPTSTEEGTSESATPESGPGTSTEPSEGSAP | 382 |
| AE576 | GSPAGSPTSTEEGTSESATPESGPGTSTEPSEGSAPGSPAGSPTSTEEGT STEPSEGSAPGTSTEPSEGSAPGTSESATPESGPGSEPATSGSETPGSEP ATSGSETPGSPAGSPTSTEEGTSESATPESGPGTSTEPSEGSAPGTSTEP SEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGS APGTSTEPSEGSAPGTSESATPESGPGTSESATPESGPGSPAGSPTSTEE GTSESATPESGPGSEPATSGSETPGTSESATPESGPGTSTEPSEGSAPGT STEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPAT SGSETPGTSESATPESGPGSEPATSGSETPGTSESATPESGPGTSTEPSE GSAPGTSESATPESGPGSPAGSPTSTEEGSPAGSPTSTEEGSPAGSPTST EEGTSESATPESGPGTSTEPSEGSAP | 383 |
| AE624 | MAEPAGSPTSTEEGTPGSGTASSSPGSSTPSGATGSPGASPGTSSTGSP GSPAGSPTSTEEGTSESATPESGPGTSTEPSEGSAPGSPAGSPTSTEEGT STEPSEGSAPGTSTEPSEGSAPGTSESATPESGPGSEPATSGSETPGSEP ATSGSETPGSPAGSPTSTEEGTSESATPESGPGTSTEPSEGSAPGTSTEP SEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGS APGTSTEPSEGSAPGTSESATPESGPGTSESATPESGPGSPAGSPTSTEE GTSESATPESGPGSEPATSGSETPGTSESATPESGPGTSTEPSEGSAPGT STEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPAT SGSETPGTSESATPESGPGSEPATSGSETPGTSESATPESGPGTSTEPSE GSAPGTSESATPESGPGSPAGSPTSTEEGSPAGSPTSTEEGSPAGSPTST EEGTSESATPESGPGTSTEPSEGSAP | 384 |
| AE864 | GSPAGSPTSTEEGTSESATPESGPGTSTEPSEGSAPGSPAGSPTSTEEGT STEPSEGSAPGTSTEPSEGSAPGTSESATPESGPGSEPATSGSETPGSEP ATSGSETPGSPAGSPTSTEEGTSESATPESGPGTSTEPSEGSAPGTSTEP SEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGS APGTSTEPSEGSAPGTSESATPESGPGTSESATPESGPGSPAGSPTSTEE GTSESATPESGPGSEPATSGSETPGTSESATPESGPGTSTEPSEGSAPGT STEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPAT SGSETPGTSESATPESGPGSEPATSGSETPGTSESATPESGPGTSTEPSE GSAPGTSESATPESGPGSPAGSPTSTEEGSPAGSPTSTEEGSPAGSPTST EEGTSESATPESGPGTSTEPSEGSAPGTSESATPESGPGSEPATSGSETP GTSESATPESGPGSEPATSGSETPGTSESATPESGPGTSTEPSEGSAPGS PAGSPTSTEEGTSESATPESGPGSEPATSGSETPGTSESATPESGPGSPA GSPTSTEEGSPAGSPTSTEEGTSTEPSEGSAPGTSESATPESGPGTSESA TPESGPGTSESATPESGPGSEPATSGSETPGSEPATSGSETPGSPAGSPT | 385 |

TABLE 5-continued

XTEN Polypeptides

| XTEN Name | Amino Acid Sequence | SEQ ID NO: |
|---|---|---|
| | STEEGTSTEPSEGSAPGTSTEPSEGSAPGSEPATSGSETPGTSESATPES GPGTSTEPSEGSAP | |
| AE865 | GGSPAGSPTSTEEGTSESATPESGPGTSTEPSEGSAPGSPAGSPTSTEEG TSTEPSEGSAPGTSTEPSEGSAPGTSESATPESGPGSEPATSGSETPGSEP ATSGSETPGSPAGSPTSTEEGTSESATPESGPGTSTEPSEGSAPGTSTEP SEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGS APGTSTEPSEGSAPGTSESATPESGPGTSESATPESGPGSPAGSPTSTEE GTSESATPESGPGSEPATSGSETPGTSESATPESGPGTSTEPSEGSAPGT STEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPAT SGSETPGTSESATPESGPGSEPATSGSETPGTSESATPESGPGTSTEPSE GSAPGTSESATPESGPGSPAGSPTSTEEGSPAGSPTSTEEGSPAGSPTST EEGTSESATPESGPGTSTEPSEGSAPGTSESATPESGPGSEPATSGSETP GTSESATPESGPGSEPATSGSETPGTSESATPESGPGTSTEPSEGSAPGS PAGSPTSTEEGTSESATPESGPGSEPATSGSETPGTSESATPESGPGSPA GSPTSTEEGSPAGSPTSTEEGTSTEPSEGSAPGTSESATPESGPGTSESA TPESGPGTSESATPESGPGSEPATSGSETPGSEPATSGSETPGSPAGSPT STEEGTSTEPSEGSAPGTSTEPSEGSAPGSEPATSGSETPGTSESATPES GPGTSTEPSEGSAP | 386 |
| AE866 | PGSPAGSPTSTEEGTSESATPESGPGTSTEPSEGSAPGSPAGSPTSTEEG TSTEPSEGSAPGTSTEPSEGSAPGTSESATPESGPGSEPATSGSETPGSEP ATSGSETPGSPAGSPTSTEEGTSESATPESGPGTSTEPSEGSAPGTSTEP SEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGS APGTSTEPSEGSAPGTSESATPESGPGTSESATPESGPGSPAGSPTSTEE GTSESATPESGPGSEPATSGSETPGTSESATPESGPGTSTEPSEGSAPGT STEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPAT SGSETPGTSESATPESGPGSEPATSGSETPGTSESATPESGPGTSTEPSE GSAPGTSESATPESGPGSPAGSPTSTEEGSPAGSPTSTEEGSPAGSPTST EEGTSESATPESGPGTSTEPSEGSAPGTSESATPESGPGSEPATSGSETP GTSESATPESGPGSEPATSGSETPGTSESATPESGPGTSTEPSEGSAPGS PAGSPTSTEEGTSESATPESGPGSEPATSGSETPGTSESATPESGPGSPA GSPTSTEEGSPAGSPTSTEEGTSTEPSEGSAPGTSESATPESGPGTSESA TPESGPGTSESATPESGPGSEPATSGSETPGSEPATSGSETPGSPAGSPT STEEGTSTEPSEGSAPGTSTEPSEGSAPGSEPATSGSETPGTSESATPES GPGTSTEPSEGSAPG | 387 |
| AE1152 | GSPAGSPTSTEEGTSESATPESGPGTSTEPSEGSAPGSPAGSPTSTEEGT STEPSEGSAPGTSTEPSEGSAPGTSESATPESGPGSEPATSGSETPGSEP ATSGSETPGSPAGSPTSTEEGTSESATPESGPGTSTEPSEGSAPGTSTEP SEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGS APGTSTEPSEGSAPGTSESATPESGPGTSESATPESGPGSPAGSPTSTEE GTSESATPESGPGSEPATSGSETPGTSESATPESGPGTSTEPSEGSAPGT STEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPAT SGSETPGTSESATPESGPGSEPATSGSETPGTSESATPESGPGTSTEPSE GSAPGTGSPGSPAGSPTSTEEGSPAGSPTSTEEGSPAGSPTST EEGTSESATPESGPGTSTEPSEGSAPGTSESATPESGPGSEPATSGSETP GTSESATPESGPGSEPATSGSETPGTSESATPESGPGTSTEPSEGSAPGS PAGSPTSTEEGTSESATPESGPGSEPATSGSETPGTSESATPESGPGSPA GSPTSTEEGSPAGSPTSTEEGTSTEPSEGSAPGTSESATPESGPGTSESA TPESGPGTSESATPESGPGSEPATSGSETPGSEPATSGSETPGSPAGSPT STEEGTSTEPSEGSAPGTSTEPSEGSAPGSEPATSGSETPGTSESATPES GPGTSTEPSEGSAPGTSESATPESGPGSEPATSGSETPGTSESATPESGP GSEPATSGSETPGTSESATPESGPGTSTEPSEGSAPGSPAGSPTSTEEGT SESATPESGPGSEPATSGSETPGTSESATPESGPGSPAGSPTSTEEGSPA GSPTSTEEGTSTEPSEGSAPGTSESATPESGPGTSESATPESGPGTSESA TPESGPGSEPATSGSETPGSEPATSGSETPGSPAGSPTSTEEGTSTEPSE GSAPGTSTEPSEGSAPGSEPATSGSETPGTSESATPESGPGTSTEPSEGS AP | 388 |
| AE144A | STEPSEGSAPGSPAGSPTSTEEGTSTEPSEGSAPGTSESATPESGPGSEP ATSGSETPGTSESATPESGPGSEPATSGSETPGTSESATPESGPGTSTEP SEGSAPGTSESATPESGPGSPAGSPTSTEEGSPAGSPTSTEEGS | 389 |
| AE144B | SEPATSGSETPGTSESATPESGPGSEPATSGSETPGTSESATPESGPGTS TEPSEGSAPGSPAGSPTSTEEGTSESATPESGPGSEPATSGSETPGTSES ATPESGPGSPAGSPTSTEEGSPAGSPTSTEEGTSTEPSEGSAPG | 390 |

TABLE 5-continued

XTEN Polypeptides

| XTEN Name | Amino Acid Sequence | SEQ ID NO: |
|---|---|---|
| AE180A | TSTEEGTSESATPESGPGSEPATSGSETPGTSESATPESGPGSPAGSPTS TEEGSPAGSPTSTEEGTSTEPSEGSAPGTSESATPESGPGTSESATPESG PGTSESATPESGPGSEPATSGSETPGSEPATSGSETPGSPAGSPTSTEEG TSTEPSEGSAPGTSTEPSEGSAPGSEPATS | 391 |
| AE216A | PESGPGTSTEPSEGSAPGSPAGSPTSTEEGTSESATPESGPGSEPATSGS ETPGTSESATPESGPGSPAGSPTSTEEGSPAGSPTSTEEGTSTEPSEGSA PGTSESATPESGPGTSESATPESGPGTSESATPESGPGSEPATSGSETPG SEPATSGSETPGSPAGSPTSTEEGTSTEPSEGSAPGTSTEPSEGSAPGSEP ATSGSETPGTSESAT | 392 |
| AE252A | ESGPGSEPATSGSETPGTSESATPESGPGTSTEPSEGSAPGSPAGSPTST EEGTSESATPESGPGSEPATSGSETPGTSESATPESGPGSPAGSPTSTEE GSPAGSPTSTEEGTSTEPSEGSAPGTSESATPESGPGTSESATPESGPGT SESATPESGPGSEPATSGSETPGSEPATSGSETPGSPAGSPTSTEEGTST EPSEGSAPGTSTEPSEGSAPGSEPATSGSETPGTSESATPESGPGTSTEPS E | 393 |
| AE288A | TPESGPGTSTEPSEGSAPGTSESATPESGPGSEPATSGSETPGTSESATP ESGPGSEPATSGSETPGTSESATPESGPGTSTEPSEGSAPGSPAGSPTST EEGTSESATPESGPGSEPATSGSETPGTSESATPESGPGSPAGSPTSTEE GSPAGSPTSTEEGTSTEPSEGSAPGTSESATPESGPGTSESATPESGPGT SESATPESGPGSEPATSGSETPGSEPATSGSETPGSPAGSPTSTEEGTST EPSEGSAPGTSTEPSEGSAPGSEPATSGSETPGTSESA | 394 |
| AE324A | PESGPGSPAGSPTSTEEGSPAGSPTSTEEGSPAGSPTSTEEGTSESATPES GPGTSTEPSEGSAPGTSESATPESGPGSEPATSGSETPGTSESATPESGP GSEPATSGSETPGTSESATPESGPGTSTEPSEGSAPGSPAGSPTSTEEGT SESATPESGPGSEPATSGSETPGTSESATPESGPGSPAGSPTSTEEGSPA GSPTSTEEGTSTEPSEGSAPGTSESATPESGPGTSESATPESGPGTSESA TPESGPGSEPATSGSETPGSEPATSGSETPGSPAGSPTSTEEGTSTEPSE GSAPGTSTEPSEGSAPGSEPATS | 395 |
| AE360A | PESGPGTSTEPSEGSAPGTSESATPESGPGSPAGSPTSTEEGSPAGSPTS TEEGSPAGSPTSTEEGTSESATPESGPGTSTEPSEGSAPGTSESATPESG PGSEPATSGSETPGTSESATPESGPGSEPATSGSETPGTSESATPESGPG TSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSES ATPESGPGTSESATPESGPGTSESATPESGPGSEPATSGSETPGSEPATS GSETPGSPAGSPTSTEEGTSTEPSEGSAPGTSTEPSEGSAPGSEPATSGS ETPGTSESAT | 396 |
| AE396A | PESGPGSEPATSGSETPGTSESATPESGPGTSTEPSEGSAPGTSESATPES GPGSPAGSPTSTEEGSPAGSPTSTEEGSPAGSPTSTEEGTSESATPESGP GTSTEPSEGSAPGTSESATPESGPGSEPATSGSETPGTSESATPESGPGS EPATSGSETPGTSESATPESGPGTSTEPSEGSAPGSPAGSPTSTEEGTSE SATPESGPGSEPATSGSETPGTSESATPESGPGSPAGSPTSTEEGSPAGS PTSTEEGTSTEPSEGSAPGTSESATPESGPGTSESATPESGPGTSESATPE SGPGSEPATSGSETPGSEPATSGSETPGSPAGSPTSTEEGTSTEPSEGSA PGTSTEPS | 397 |
| AE432A | EGSAPGSPAGSPTSTEEGTSTEPSEGSAPGTSESATPESGPGSEPATSGS ETPGTSESATPESGPGSEPATSGSETPGTSESATPESGPGTSTEPSEGSA PGTSESATPESGPGSPAGSPTSTEEGSPAGSPTSTEEGSPAGSPTSTEEG TSESATPESGPGTSTEPSEGSAPGTSESATPESGPGSEPATSGSETPGTS ESATPESGPGSEPATSGSETPGTSESATPESGPGTSTEPSEGSAPGSPAG SPTSTEEGTSESATPESGPGSEPATSGSETPGTSESATPESGPGSPAGSPT STEEGSPAGSPTSTEEGTSTEPSEGSAPGTSESATPESGPGTSESATPES GPGTSESATPESGPGSEPATSGSETPGSEPATSGSETPGSPAGSPTSTEE GTSTEPSEGSAPGTSTEPSEGSAPGSEPATS | 398 |
| AE468A | EGSAPGTSTEPSEGSAPGTSTEPSEGSAPGSPAGSPTSTEEGTSTEPSEG SAPGTSESATPESGPGSEPATSGSETPGTSESATPESGPGSEPATSGSET PGTSESATPESGPGTSTEPSEGSAPGTSESATPESGPGSPAGSPTSTEEG SPAGSPTSTEEGSPAGSPTSTEEGTSESATPESGPGTSTEPSEGSAPGTS ESATPESGPGSEPATSGSETPGTSESATPESGPGSEPATSGSETPGTSES ATPESGPGTSTEPSEGSAPGSPAGSPTSTEEGTSESATPESGPGSEPATS GSETPGTSESATPESGPGSPAGSPTSTEEGSPAGSPTSTEEGTSTEPSEG SAPGTSESATPESGPGTSESATPESGPGTSESATPESGPGSEPATSGSET PGSEPATSGSETPGSPAGSPTSTEEGTSTEPSEGSAPGTSTEPSEGSAPG SEPATSGSETPGTSESAT | 399 |
| AE504A | EGSAPGTSTEPSEGSAPGTSTEPSEGSAPGTSTEPSEGSAPGTSTEPSEG SAPGSPAGSPTSTEEGTSTEPSEGSAPGTSESATPESGPGSEPATSGSET | 400 |

TABLE 5-continued

XTEN Polypeptides

| XTEN Name | Amino Acid Sequence | SEQ ID NO: |
|---|---|---|
| | PGTSESATPESGPGSEPATSGSETPGTSESATPESGPGTSTEPSEGSAPG TSESATPESGPGSPAGSPTSTEEGSPAGSPTSTEEGSPAGSPTSTEEGTS ESATPESGPGTSTEPSEGSAPGTSESATPESGPGSEPATSGSETPGTSES ATPESGPGTSTEPSEGSETPGTSESATPESGPGTSTEPSEGSAPGSPAGSP TSTEEGTSESATPESGPGSEPATSGSETPGTSESATPESGPGSPAGSPTS TEEGSPAGSPTSTEEGTSTEPSEGSAPGTSESATPESGPGTSESATPESG PGTSESATPESGPGSEPATSGSETPGSEPATSGSETPGSPAGSPTSTEEG TSTEPSEGSAPGTSTEPSEGSAPGSEPATSGSETPGTSESATPESGPGTS TEPS | |
| AE540A | TPESGPGSPAGSPTSTEEGTSESATPESGPGSEPATSGSETPGTSESATP ESGPGTSTEPSEGSAPGTSTEPSEGSAPGTSTEPSEGSAPGTSTEPSEGS APGTSTEPSEGSAPGTSTEPSEGSAPGSPAGSPTSTEEGTSTEPSEGSAP GTSESATPESGPGSEPATSGSETPGTSESATPESGPGSEPATSGSETPGT SESATPESGPGTSTEPSEGSAPGTSESATPESGPGSPAGSPTSTEEGSPA GSPTSTEEGSPAGSPTSTEEGTSESATPESGPGTSTEPSEGSAPGTSESA TPESGPGSEPATSGSETPGTSESATPESGPGSEPATSGSETPGTSESATP ESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAP GTSESATPESGPGTSESATPESGPGTSESATPESGPGSEPATSGSETPGS EPATSGSETPGSPAGSPTSTEEGTSTEPSEGSAPGTSTEP | 401 |
| AE576A | TPESGPGTSESATPESGPGSPAGSPTSTEEGTSESATPESGPGSEPATSG SETPGTSESATPESGPGTSTEPSEGSAPGTSTEPSEGSAPGTSTEPSEGS APGTSTEPSEGSAPGTSTEPSEGSAPGTSTEPSEGSAPGSPAGSPTSTEE GTSTEPSEGSAPGTSESATPESGPGSEPATSGSETPGTSESATPESGPGS EPATSGSETPGTSESATPESGPGTSTEPSEGSAPGTSESATPESGPGSPA GSPTSTEEGSPAGSPTSTEEGSPAGSPTSTEEGTSESATPESGPGTSTEPS EGSAPGTSESATPESGPGSEPATSGSETPGTSESATPESGPGSEPATSGS ETPGTSESATPESGPGTSTEPSEGSAPGSPAGSPTSTEEGTSESATPESG PGSEPATSGSETPGTSESATPESGPGSPAGSPTSTEEGSPAGSPTSTEEG TSTEPSEGSAPGTSESATPESGPGTSESATPESGPGTSESATPESGPGSEP ATSGSETPGSEPATSGSETPGSPAGSPTSTEEGTSTEPSEGSAPGTSTEP SEGSAPGSEPATSGSETPGTSESA | 402 |
| AE612A | GSETPGTSTEPSEGSAPGTSTEPSEGSAPGTSESATPESGPGTSESATPE SGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPG TSTEPSEGSAPGTSTEPSEGSAPGSPAGSPTSTEEGTSTEPSEGSAPGTS ESATPESGPGSEPATSGSETPGTSESATPESGPGSEPATSGSETPGTSES ATPESGPGTSTEPSEGSAPGTSESATPESGPGSPAGSPTSTEEGSPAGSP TSTEEGSPAGSPTSTEEGTSESATPESGPGTSTEPSEGSAPGTSESATPES GPGSEPATSGSETPGTSESATPESGPGSEPATSGSETPGTSESATPESGP GTSTEPSEGSAPGSPAGSPTSTEEGTSESATPESGPGSEPATSGSETPGT SESATPESGPGSPAGSPTSTEEGSPAGSPTSTEEGTSTEPSEGSAPGTSES ATPESGPGTSESATPESGPGTSESATPESGPGSEPATSGSETPGSEPATS GSETPGSPAGSPTSTEEGTSTEPSEGSAPGTSTEPSEGSAPGSEPATSGS ETPGTSESAT | 403 |
| AE648A | PESGPGTSTEPSEGSAPGTSESATPESGPGSEPATSGSETPGTSTEPSEGS APGTSTEPSEGSAPGTSESATPESGPGTSESATPESGPGSPAGSPTSTEE GTSESATPESGPGSEPATSGSETPGTSESATPESGPGTSTEPSEGSAPGT STEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPAT SGSETPGTSESATPESGPGSEPATSGSETPGTSESATPESGPGTSTEPSE GSAPGTSESATPESGPGSPAGSPTSTEEGSPAGSPTSTEEGSPAGSPTST EEGTSESATPESGPGTSTEPSEGSAPGTSESATPESGPGSEPATSGSETP GTSESATPESGPGSEPATSGSETPGTSESATPESGPGTSTEPSEGSAPGS PAGSPTSTEEGTSESATPESGPGSEPATSGSETPGTSESATPESGPGSPA GSPTSTEEGSPAGSPTSTEEGTSTEPSEGSAPGTSESATPESGPGTSESA TPESGPGTSESATPESGPGSEPATSGSETPGSEPATSGSETPGSPAGSPT STEEGTSTEPSEGSAPGTSTEPSEGSAPGSEPATSGSETPGTSESAT | 404 |
| AE684A | EGSAPGSPAGSPTSTEEGTSTEPSEGSAPGTSTEPSEGSAPGTSESATPE SGPGTSTEPSEGSAPGTSESATPESGPGSEPATSGSETPGTSTEPSEGSA PGTSTEPSEGSAPGTSESATPESGPGTSESATPESGPGSPAGSPTSTEEG TSESATPESGPGSEPATSGSETPGTSESATPESGPGTSTEPSEGSAPGTS TEPSEGSAPGTSTEPSEGSAPGTSTEPSEGSAPGTSTEPSEGSAPGTSTE PSEGSAPGSPAGSPTSTEEGTSTEPSEGSAPGTSESATPESGPGSEPATS GSETPGTSESATPESGPGSEPATSGSETPGTSESATPESGPGTSTEPSEG SAPGTSESATPESGPGSPAGSPTSTEEGSPAGSPTSTEEGSPAGSPTSTE EGTSESATPESGPGTSTEPSEGSAPGTSESATPESGPGSEPATSGSETPG TSESATPESGPGSEPATSGSETPGTSESATPESGPGTSTEPSEGSAPGSP AGSPTSTEEGTSESATPESGPGSEPATSGSETPGTSESATPESGPGSPAG | 405 |

TABLE 5-continued

XTEN Polypeptides

| XTEN Name | Amino Acid Sequence | SEQ ID NO: |
|---|---|---|
| | SPTSTEEGSPAGSPTSTEEGTSTEPSEGSAPGTSESATPESGPGTSESATP ESGPGTSESATPESGPGSEPATSGSETPGSEPATSGSETPGSPAGSPTST EEGTSTEPSEGSAPGTSTEPSEGSAPGSEPATS | |
| AE720A | TSGSETPGSEPATSGSETPGSPAGSPTSTEEGTSESATPESGPGTSTEPSE GSAPGTSTEPSEGSAPGSPAGSPTSTEEGTSTEPSEGSAPGTSTEPSEGS APGTSESATPESGPGTSTEPSEGSAPGTSESATPESGPGSEPATSGSETP GTSTEPSEGSAPGTSTEPSEGSAPGTSESATPESGPGTSESATPESGPGS PAGSPTSTEEGTSESATPESGPGSEPATSGSETPGTSESATPESGPGTST EPSEGSAPGTSTEPSEGSAPGTSTEPSEGSAPGTSTEPSEGSAPGTSTEPS EGSAPGTSTEPSEGSAPGSPAGSPTSTEEGTSTEPSEGSAPGTSESATPE SGPGSEPATSGSETPGTSESATPESGPGSEPATSGSETPGTSESATPESG PGTSTEPSEGSAPGTSESATPESGPGSPAGSPTSTEEGSPAGSPTSTEEG SPAGSPTSTEEGTSESATPESGPGTSTEPSEGSAPGTSESATPESGPGSEP ATSGSETPGTSESATPESGPGSEPATSGSETPGTSESATPESGPGTSTEP SEGSAPGSPAGSPTSTEEGTSESATPESGPGSEPATSGSETPGTSESATP ESGPGSPAGSPTSTEEGSPAGSPTSTEEGTSTEPSEGSAPGTSESATPES GPGTSESATPESGPGTSESATPESGPGSEPATSGSETPGSEPATSGSETP GSPAGSPTSTEEGTSTE | 406 |
| AE756A | TSGSETPGSEPATSGSETPGSPAGSPTSTEEGTSESATPESGPGTSTEPSE GSAPGTSTEPSEGSAPGSPAGSPTSTEEGTSTEPSEGSAPGTSTEPSEGS APGTSESATPESGPGTSTEPSEGSAPGTSESATPESGPGSEPATSGSETP GTSTEPSEGSAPGTSTEPSEGSAPGTSESATPESGPGTSESATPESGPGS PAGSPTSTEEGTSESATPESGPGSEPATSGSETPGTSESATPESGPGTST EPSEGSAPGTSTEPSEGSAPGTSTEPSEGSAPGTSTEPSEGSAPGTSTEPS EGSAPGTSTEPSEGSAPGSPAGSPTSTEEGTSTEPSEGSAPGTSESATPE SGPGSEPATSGSETPGTSESATPESGPGSEPATSGSETPGTSESATPESG PGTSTEPSEGSAPGTSESATPESGPGSPAGSPTSTEEGSPAGSPTSTEEG SPAGSPTSTEEGTSESATPESGPGTSTEPSEGSAPGTSESATPESGPGSEP ATSGSETPGTSESATPESGPGSEPATSGSETPGTSESATPESGPGTSTEP SEGSAPGSPAGSPTSTEEGTSESATPESGPGSEPATSGSETPGTSESATP ESGPGSPAGSPTSTEEGSPAGSPTSTEEGTSTEPSEGSAPGTSESATPES GPGTSESATPESGPGTSESATPESGPGSEPATSGSETPGSEPATSGSETP GSPAGSPTSTEEGTSTEPSEGSAPGTSTEPSEGSAPGSEPATSGSETPGT SES | 407 |
| AE792A | EGSAPGTSESATPESGPGSEPATSGSETPGSEPATSGSETPGSPAGSPTS TEEGTSESATPESGPGTSTEPSEGSAPGTSTEPSEGSAPGSPAGSPTSTE EGTSTEPSEGSAPGTSTEPSEGSAPGTSESATPESGPGTSTEPSEGSAPG TSESATPESGPGSEPATSGSETPGTSTEPSEGSAPGTSTEPSEGSAPGTS ESATPESGPGTSESATPESGPGSPAGSPTSTEEGTSESATPESGPGSEPA TSGSETPGTSESATPESGPGTSTEPSEGSAPGTSTEPSEGSAPGTSTEPSE GSAPGTSTEPSEGSAPGTSTEPSEGSAPGTSTEPSEGSAPGSPAGSPTST EEGTSTEPSEGSAPGTSESATPESGPGSEPATSGSETPGTSESATPESGP GSEPATSGSETPGTSESATPESGPGTSTEPSEGSAPGTSESATPESGPGS PAGSPTSTEEGSPAGSPTSTEEGSPAGSPTSTEEGTSESATPESGPGTST EPSEGSAPGTSESATPESGPGSEPATSGSETPGTSESATPESGPGSEPAT SGSETPGTSESATPESGPGTSTEPSEGSAPGSPAGSPTSTEEGTSESATP ESGPGSEPATSGSETPGTSESATPESGPGSPAGSPTSTEEGSPAGSPTST EEGTSTEPSEGSAPGTSESATPESGPGTSESATPESGPGTSESATPESGP GSEPATSGSETPGSEPATSGSETPGSPAGSPTSTEEGTSTEPSEGSAPGT STEPSEGSAPGSEPATSGSETPGTSESATPESGPGTSTEPS | 408 |
| AE828A | PESGPGTSTEPSEGSAPGSPAGSPTSTEEGTSTEPSEGSAPGTSTEPSEGS APGTSESATPESGPGSEPATSGSETPGSEPATSGSETPGSPAGSPTSTEE GTSESATPESGPGTSTEPSEGSAPGTSTEPSEGSAPGSPAGSPTSTEEGT STEPSEGSAPGTSTEPSEGSAPGTSESATPESGPGTSTEPSEGSAPGTSES ATPESGPGSEPATSGSETPGTSTEPSEGSAPGTSTEPSEGSAPGTSESAT PESGPGTSESATPESGPGSPAGSPTSTEEGTSESATPESGPGSEPATSGS ETPGTSESATPESGPGTSTEPSEGSAPGTSTEPSEGSAPGTSTEPSEGSA PGTSTEPSEGSAPGTSTEPSEGSAPGTSTEPSEGSAPGSPAGSPTSTEEG TSTEPSEGSAPGTSESATPESGPGSEPATSGSETPGTSESATPESGPGSEP ATSGSETPGTSESATPESGPGTSTEPSEGSAPGTSESATPESGPGSPAGS PTSTEEGSPAGSPTSTEEGSPAGSPTSTEEGTSESATPESGPGTSTEPSEG SAPGTSESATPESGPGSEPATSGSETPGTSESATPESGPGSEPATSGSET PGTSESATPESGPGTSTEPSEGSAPGSPAGSPTSTEEGTSESATPESGPG SEPATSGSETPGTSESATPESGPGSPAGSPTSTEEGSPAGSPTSTEEGTS TEPSEGSAPGTSESATPESGPGTSESATPESGPGTSESATPESGPGSEPA TSGSETPGSEPATSGSETPGSPAGSPTSTEEGTSTEPSEGSAPGTSTEPSE GSAPGSEPATSGSETPGTSESAT | 409 |
| AE869 | GSPGSPAGSPTSTEEGTSESATPESGPGTSTEPSEGSAPGSPAGSPTSTE EGTSTEPSEGSAPGTSTEPSEGSAPGTSESATPESGPGSEPATSGSETPG | 410 |

TABLE 5-continued

XTEN Polypeptides

| XTEN Name | Amino Acid Sequence | SEQ ID NO: |
|---|---|---|
| | SEPATSGSETPGSPAGSPTSTEEGTSESATPESGPGTSTEPSEGSAPGTS TEPSEGSAPGSPAGSPTSTEEGTSTEPSEGSAPGTSTEPSEGSAPGTSES ATPESGPGTSTEPSEGSAPGTSESATPESGPGSEPATSGSETPGTSTEPS EGSAPGTSTEPSEGSAPGTSESATPESGPGTSESATPESGPGSPAGSPTS TEEGTSESATPESGPGSEPATSGSETPGTSESATPESGPGTSTEPSEGSA PGTSTEPSEGSAPGTSTEPSEGSAPGTSTEPSEGSAPGTSTEPSEGSAPG TSTEPSEGSAPGSPAGSPTSTEEGTSTEPSEGSAPGTSESATPESGPGSEP ATSGSETPGTSESATPESGPGSEPATSGSETPGTSESATPESGPGTSTEP SEGSAPGTSESATPESGPGSPAGSPTSTEEGSPAGSPTSTEEGSPAGSPT STEEGTSESATPESGPGTSTEPSEGSAPGTSESATPESGPGSEPATSGSE TPGTSESATPESGPGSEPATSGSETPGTSESATPESGPGTSTEPSEGSAP GSPAGSPTSTEEGTSESATPESGPGSEPATSGSETPGTSESATPESGPGS PAGSPTSTEEGSPAGSPTSTEEGTSTEPSEGSAPGTSESATPESGPGTSE SATPESGPGTSESATPESGPGSEPATSGSETPGSEPATSGSETPGSPAGS PTSTEEGTSTEPSEGSAPGTSTEPSEGSAPGSEPATSGSETPGTSESATPE SGPGTSTEPSEGSAPGR | |
| AE144_R1 | SAGSPGSPAGSPTSTEEGTSESATPESGPGTSTEPSEGSAPGSPAGSPTS TEEGTSTEPSEGSAPGTSTEPSEGSAPGTSESATPESGPGSEPATSGSET PGSEPATSGSETPGSPAGSPTSTEEGTSESATPESGPGTESASR | 411 |
| AE288_R1 | SAGSPTGPGSEPATSGSETPGTSESATPESGPGSEPATSGSETPGTSESA TPESGPGTSTEPSEGSAPGSPAGSPTSTEEGTSESATPESGPGSEPATSG SETPGTSESATPESGPGSPAGSPTSTEEGSPAGSPTSTEEGTSTEPSEGS APGTSESATPESGPGTSESATPESGPGTSESATPESGPGSEPATSGSETP GSEPATSGSETPGSPAGSPTSTEEGTSTEPSEGSAPGTSTEPSEGSAPGS EPATSGSETPGTSESATPESGPGTSTEPSEGSAPSASR | 412 |
| AE432_R1 | SAGSPGSPAGSPTSTEEGTSESATPESGPGTSTEPSEGSAPGSPAGSPTS TEEGTSTEPSEGSAPGTSTEPSEGSAPGTSESATPESGPGSEPATSGSET PGSEPATSGSETPGSPAGSPTSTEEGTSESATPESGPGTSTEPSEGSAPG TSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTE PSEGSAPGTSTEPSEGSAPGTSESATPESGPGTSESATPESGPGSPAGSP TSTEEGTSESATPESGPGSEPATSGSETPGTSESATPESGPGTSTEPSEGS APGTSTEPSEGSAPGTSTEPSEGSAPGTSTEPSEGSAPGTSTEPSEGSAP GTSTEPSEGSAPGSPAGSPTSTEEGTESASR | 413 |
| AE576_R1 | SAGSPTEEGTSESATPESGPGSEPATSGSETPGTSESATPESGPGTSTEP SEGSAPGTSTEPSEGSAPGTSTEPSEGSAPGTSTEPSEGSAPGTSTEPSE GSAPGTSTEPSEGSAPGSPAGSPTSTEEGTSTEPSEGSAPGTSESATPES GPGSEPATSGSETPGTSESATPESGPGSEPATSGSETPGTSESATPESGP GTSTEPSEGSAPGTSESATPESGPGSPAGSPTSTEEGSPAGSPTSTEEGS PAGSPTSTEEGTSESATPESGPGTSTEPSEGSAPGTSESATPESGPGSEP ATSGSETPGTSESATPESGPGSEPATSGSETPGTSESATPESGPGTSTEP SEGSAPGSPAGSPTSTEEGTSESATPESGPGSEPATSGSETPGTSESATP ESGPGSPAGSPTSTEEGSPAGSPTSTEEGTSTEPSEGSAPGTSESATPES GPGTSESATPESGPGTSESATPESGPGSEPATSGSETPGSEPATSGSETP GSPAGSPTSTEEGTSTEPSEGSAPGTSTEPSEGSAPGSEPATSGSETPGT SESATPESGPGTSTEPSEGSAPSASR | 414 |
| AE864_R1 | SAGSPGSPAGSPTSTEEGTSESATPESGPGTSTEPSEGSAPGSPAGSPTS TEEGTSTEPSEGSAPGTSTEPSEGSAPGTSESATPESGPGSEPATSGSET PGSEPATSGSETPGSPAGSPTSTEEGTSESATPESGPGTSTEPSEGSAPG TSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTE PSEGSAPGTSTEPSEGSAPGTSESATPESGPGTSESATPESGPGSPAGSP TSTEEGTSESATPESGPGSEPATSGSETPGTSESATPESGPGTSTEPSEGS APGTSTEPSEGSAPGTSTEPSEGSAPGTSTEPSEGSAPGTSTEPSEGSAP GTSTEPSEGSAPGSPAGSPTSTEEGTSTEPSEGSAPGTSESATPESGPGS EPATSGSETPGTSESATPESGPGSEPATSGSETPGTSESATPESGPGTST EPSEGSAPGTSESATPESGPGSPAGSPTSTEEGSPAGSPTSTEEGSPAGS PTSTEEGTSESATPESGPGTSTEPSEGSAPGTSESATPESGPGSEPATSG SETPGTSESATPESGPGSEPATSGSETPGTSESATPESGPGTSTEPSEGS APGSPAGSPTSTEEGTSESATPESGPGSEPATSGSETPGTSESATPESGP GSPAGSPTSTEEGSPAGSPTSTEEGTSTEPSEGSAPGTSESATPESGPGT SESATPESGPGTSESATPESGPGSEPATSGSETPGSEPATSGSETPGSPA GSPTSTEEGTSTEPSEGSAPGTSTEPSEGSAPGSEPATSGSETPGTSESA TPESGPGTESASR | 415 |
| AE712 | PGSPAGSPTSTEEGTSESATPESGPGTSTEPSEGSAPGSPAGSPTSTEEG TSTEPSEGSAPGTSTEPSEGSAPGTSESATPESGPGSEPATSGSETPGSEP ATSGSETPGSPAGSPTSTEEGTSESATPESGPGTSTEPSEGSAPGTSTEP SEGSAPGSPAGSPTSTEEGTSTEPSEGSAPGTSTEPSEGSAPGTSESATP | 416 |

TABLE 5-continued

XTEN Polypeptides

| XTEN Name | Amino Acid Sequence | SEQ ID NO: |
|---|---|---|
| | ESGPGTSTEPSEGSAPGTSESATPESGPGSEPATSGSETPGTSTEPSEGS APGTSTEPSEGSAPGTSESATPESGPGTSESATPESGPGSPAGSPTSTEE GTSESATPESGPGSEPATSGSETPGTSESATPESGPGTSTEPSEGSAPGT STEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPAT SGSETPGTSESATPESGPGSEPATSGSETPGTSESATPESGPGTSTEPSE GSAPGTSESATPESGPGSPAGSPTSTEEGSPAGSPTSTEEGSPAGSPTST EEGTSESATPESGPGTSTEPSEGSAPGTSESATPESGPGSEPATSGSETP GTSESATPESGPGSEPATSGSETPGTSESATPESGPGTSTEPSEGSAPGS PAGSPTSTEEGTSESATPESGPGSEPATSGSETPGTSESATPESGPGSPA GSPTSTEAHHH | |
| AE864_R2 | GSPGAGSPAGSPTSTEEGTSESATPESGPGTSTEPSEGSAPGSPAGSPTS TEEGTSTEPSEGSAPGTSTEPSEGSAPGTSESATPESGPGSEPATSGSET PGSEPATSGSETPGSPAGSPTSTEEGTSESATPESGPGTSTEPSEGSAPG TSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTE PSEGSAPGTSTEPSEGSAPGTSESATPESGPGTSESATPESGPGSPAGSP TSTEEGTSESATPESGPGSEPATSGSETPGTSESATPESGPGTSTEPSEGS APGTSTEPSEGSAPGTSTEPSEGSAPGTSTEPSEGSAPGTSTEPSEGSAP GTSTEPSEGSAPGSPAGSPTSTEEGTSTEPSEGSAPGTSESATPESGPGS EPATSGSETPGTSESATPESGPGSEPATSGSETPGTSESATPESGPGTST EPSEGSAPGTSESATPESGPGSPAGSPTSTEEGSPAGSPTSTEEGSPAGS PTSTEEGTSESATPESGPGTSTEPSEGSAPGTSESATPESGPGSEPATSG SETPGTSESATPESGPGSEPATSGSETPGTSESATPESGPGTSTEPSEGS APGSPAGSPTSTEEGTSESATPESGPGSEPATSGSETPGTSESATPESGP GSPAGSPTSTEEGSPAGSPTSTEEGTSTEPSEGSAPGTSESATPESGPGT SESATPESGPGTSESATPESGPGSEPATSGSETPGSEPATSGSETPGSPA GSPTSTEEGTSTEPSEGSAPGTSTEPSEGSAPGSEPATSGSETPGTSESA TPESGPGTESASR | 417 |

The invention contemplates chimeric polypeptide assembly compositions comprising XTEN of intermediate lengths to those of Table 5, as well as XTEN of longers lengths in which motifs of 12 amino acids are added to the N- or C-terminus of an XTEN of Table 5 incorporated into the chimeric polypeptide assembly. In one embodiment, the chimeric polypeptide assembly composition comprises an XTEN of Table 5 with the addition of one or more copies of one or more motifs selected from the group of motifs set forth in Table 6.

TABLE 6

XTEN Sequence Motifs of 12 Amino Acids and Motif Families

| Motif Family* | MOTIF SEQUENCE | SEQ ID NO: |
|---|---|---|
| AD | GESPGGSSGSES | 418 |
| AD | GSEGSSGPGESS | 419 |
| AD | GSSESGSSEGGP | 420 |
| AD | GSGGEPSESGSS | 421 |
| AE | GSPAGSPTSTEE | 422 |
| AE | GSEPATSGSETP | 423 |
| AE | GTSESATPESGP | 424 |
| AE | GTSTEPSEGSAP | 425 |
| AF | GSTSESPSGTAP | 426 |
| AF | GTSTPESGSASP | 427 |

TABLE 6-continued

XTEN Sequence Motifs of 12 Amino Acids and Motif Families

| Motif Family* | MOTIF SEQUENCE | SEQ ID NO: |
|---|---|---|
| AF | GTSPSGESSTAP | 428 |
| AF | GSTSSTAESPGP | 429 |

*Denotes individual motif sequences that, when used together in various permutations, results in a "family sequence"

Additional examples of XTEN sequences that can be used according to the present invention and are disclosed in US Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, WO 2014/011819 A2, or WO 2015/023891.

4. T Cell Binding Compositions

Figure 29A:
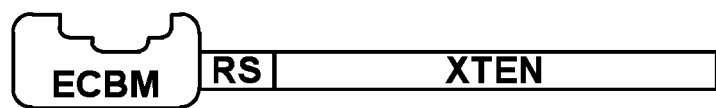
Figure 29B:
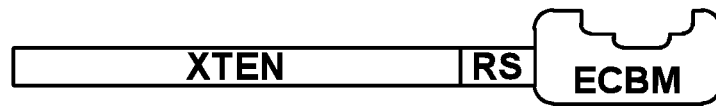
FIG. 29B shows the configuration of XTEN followed by the RS segment and then ECBM.

In another aspect, the present invention provides monomeric fusion proteins comprising a first portion, a second portion, and a third portion wherein said first portion comprises VL and VH sequences of an anti-CD3 binding domain, joined by a flexible linker; the said second portion comprises a first release segment (RS) capable of being cleaved by a mammalian protease; and the third portion comprises a first bulking moiety comprising an XTEN sequence wherein said bulking moiety and first portions are capable of being released from the composition by action of said mammalian protease on said second portion. In some embodiments of the foregoing, the first portion VL and VH sequences of the subject composition are derived from a monoclonal antibody VL and VH selected from the group of sequences set forth in Table 1. Where desired, the VL and VH of the subject compositions are derived from the huUCHT1 monoclonal antibody of Table 1. It is specifically contemplated that the compositions can be configured in different orders, with respect to the N-terminus to C-terminus order, as shown schematically in FIG. 29. In one embodiment, the compositions are configured, in an N- to C-terminus orientation of binding domains-RS-XTEN and in another embodiment the portions are configured in the order XTEN-RS-binding domains.

In some embodiments of the T-cell binding compositions, the anti-CD3 binding domains comprise a VH and a VL sequence of Table 1, the RS of the second portion is selected from the group consisting of the sequences set forth in Table 4 and the XTEN of the third portion is selected from the group consisting of the sequences set forth in Table 5.

In other embodiments, the invention provides T-cell binding composition fusion proteins having at least about 90% sequence identity, or at least about 91%, 92%, 93%, 94%, 95%, 96%, 97%, 98%, 99% identity, or is 100% identical to a sequence, when optimally aligned, selected from the group consisting of the amino acid sequences set forth in Table 7. In one embodiment, the T-cell binding composition has the amino acid sequence of TCB-1 of Table 7. In another embodiment, the T-cell binding composition has the amino acid sequence of TCB-2 of Table 7. In another embodiment, the T-cell binding composition has the amino acid sequence of TCB-3 of Table 7. In another embodiment, the T-cell binding composition has the amino acid sequence of TCB-4 of Table 7. In another embodiment, the T-cell binding composition has the amino acid sequence of TCB-5 of Table 7. In another embodiment, the T-cell binding composition has the amino acid sequence of TCB-6 of Table 7. In another embodiment, the T-cell binding composition has the amino acid sequence of TCB7 of Table 7. In another embodiment, the T-cell binding composition has the amino acid sequence of TCB-8 of Table 7. In another embodiment, the T-cell binding composition has the amino acid sequence of TCB-9 of Table 7. In another embodiment, the T-cell binding composition has the amino acid sequence of TCB-10 of Table 7. In another embodiment, the T-cell binding composition has the amino acid sequence of TCB11 of Table 7. In another embodiment, the T-cell binding composition has the amino acid sequence of TCB-12 of Table 7. In another embodiment, the T-cell binding composition has the amino acid sequence of TCB-13 of Table 7. In another embodiment, the T-cell binding composition has the amino acid sequence of TCB-14 of Table 7. In another embodiment, the T-cell binding composition has the amino acid sequence of TCB-15 of Table 7. In another embodiment, the T-cell binding composition has the amino acid sequence of TCB-16 of Table 7. In still other embodiments, the invention provides pharmaceutical compositions comprising T-cell binding composition fusion proteins with at least about 90% sequence identity, or at least about 91%, 92%, 93%, 94%, 95%, 96%, 97%, 98%, 99% identity, or is 100% identical to a sequence set forth in Table 7 and, optionally, suitable formulations of carrier, stabilizers and/or excipients.

In another aspect, the invention relates to polynucleotides encoding the T-cell binding composition fusion proteins of Table 7. In one embodiment, the invention provides polynucleotide sequences encoding T-cell binding fusion proteins, wherein the polynucleotide sequences have at least about 90% sequence identity, or at least about 91%, 92%, 93%, 94%, 95%, 96%, 97%, 98%, 99% identity, or is 100% identical to a sequence, when optimally aligned, selected from the group consisting of the polynucleotide sequences set forth in Table 7, or the complement thereof.

In a related aspect, the invention relates to a method of making chimeric polypeptide assembly compositions utilizing a polynucleotide encoding a T-cell binding contract composition and ligating a polynucleotide sequence encoding a binding domain with affinity to a target cell antigen. In one embodiment, the invention provides a method of making chimeric polypeptide assembly compositions, the method comprising utilizing a polynucleotide of Table 7 encoding T-cell binding contract compositions followed by the recombinant addition of a gene encoding the second binding domain and a linker wherein the second binding domain has binding specificity to a tumor-specific marker or an antigen of a target cell, with the resulting gene introduced into a suitable expression vector under the control of a promoter and linker; the resulting expression vector is then used to transform a suitable *E. coli* host cell, which is then grown under conditions suitable for the expression of the chimeric polypeptide assembly fusion protein, which is then isolated by purification methods described herein or known in the art. Examples 1 and 2, below, provide exemplary methods for the implementation of the foregoing method. In some embodiments of the foregoing, the second binding domain is a scFv wherein the second binding domain VH and VL are selected from the group of paired monoclonal antibody VH and VL sequences set forth in Table 2. The foregoing embodiments take advantage of the modular nature of the genes encoding the T-cell binding compositions that can be readily utilized with polynucleotides encoding the variety of second binding domains described herein by recombinantly fusing the encoding sequences of the anti-CD3 variable sequence and the encoding sequence of the second binding domain to the encoding sequences of the T-cell binding composition, resulting in the ability to create multiple individual genes that can be utilized to express the desired fusion protein product of a chimeric polypeptide assembly. It is specifically contemplated that the use of a gene encoding a T-cell binding composition to prepare chimeric polypeptide assembly compositions is not limited to the polynucleotides encoding the chimeric polypeptide assembly compositions described herein, but could be utilized in conjunction with a gene encoding a binding domain with affinity to any target tissue or cell of interest that would be susceptible to the cytotoxic effects of the resulting expressed fusion protein.

In another aspect, the T-cell binding compositions of Table 7 are useful as therapeutic immunosuppressive agents in the treatment of certain diseases or conditions in a subject for which anti-CD3 antibody preparations have been demonstrated to result in clinical benefits such as, but not limited to organ transplant and acute graft rejection, Crohn's disease, ulcerative colitis and type 1 diabetes, and for inducing immune tolerance.

TABLE 7

T-cell binding compositions

| Construct Name | Amino Acid Sequence | SEQ ID NO: | DNA Sequence | SEQ ID NO: |
|---|---|---|---|---|
| TBP-1 | DIQMTQSPSSLSA SVGDRVTITCRAS QDIRNYLNWYQQK PGKAPKLLIYYTS RLESGVPSRFSGS GSGTDYTLTISSL QPEDFATYYCQQG NTLPWTFGQGTKV EIKGATPPETGAE TESPGETTGGSAE SEPPGEGEVQLVE SGGGLVQPGGSLR LSCAASGYSFTGY TMNWVRQAPGKGL EWVALINPYKGVS TYNQKFKDRFTIS VDKSKNTAYLQMN SLRAEDTAVYYCA RSGYYGDSDWYFD VWGQGTLVTVSSG TAEAASASGLSGR SDNHSPLGLAGSP GSPAGSPTSTEEG TSESATPESGPGT STEPSEGSAPGSP AGSPTSTEEGTST EPSEGSAPGTSTE PSEGSAPGTSESA TPESGPGSEPATS GSETPGSEPATSG SETPGSPAGSPTS TEEGTSESATPES GPGTSTEPSEGSA PGTSTEPSEGSAP GSPAGSPTSTEEG TSTEPSEGSAPGT STEPSEGSAPGTS ESATPESGPGTST EPSEGSAPGTSES ATPESGPGSEPAT SGSETPGTSTEPS EGSAPGTSTEPSE GSAPGTSESATPE SGPGTSESATPES GPGSPAGSPTSTE EGTSESATPESGP GSEPATSGSETPG TSESATPESGPGT STEPSEGSAPGTS TEPSEGSAPGTST EPSEGSAPGTSTE PSEGSAPGTSTEP SEGSAPGTSTEPS EGSAPGSPAGSPT STEEGTSTEPSEG SAPGTSESATPES GPGSEPATSGSET PGTSESATPESGP GSEPATSGSETPG TSESATPESGPGT STEPSEGSAPGTS ESATPESGPGSPA GSPTSTEEGSPAG SPTSTEEGSPAGS PTSTEEGTSESAT PESGPGTSTEPSE GSAPGTSESATPE SGPGSEPATSGSE TPGTSESATPESG PGSEPATSGSETP GTSESATPESGPG TSTEPSEGSAPGS PAGSPTSTEEGTS ESATPESGPGSEP | 430 | GACATCCAAATGACCCAGAGCCCGAGCAGCCTGA GCGCGAGCGTGGGCGACCGTGTTACCATCCTG CCGTGCGAGCCAAGACATCCGTAACTACCTGAAC TGGTATCAGCAAAAGCCGGGTAAAGCGCCGAAGC TGCTGATCTACTATACCAGCCGTCTGGAGAGCGG CGTGCCGAGCCGTTTCAGCGGTAGCGGTAGCGGT ACCGACTACACCCTGACCATTAGCAGCCTGCAGC CGGAAGATTTCGCGACCTACTATTGCCAGCAGGG TAACACCCTGCCGTGGACCTTTGGTCAAGGCACC AAAGTTGAGATTAAAGGCGCCACGCCTCCGGAAA CTGGTGCTGAGACGGAATCCCCTGGTGAAGGCGA GGGCGAGGTGCAGCTGGTTGAAAGCGGTGGCGGTC TGGTGCAACCAGGCGGTAGCCTGCGTCTGAGCTG CGCGGCGAGCGGTTACAGCTTTACCGGTTATACC ATGAACTGGGTTCGTCAAGCGCCAGGTAAAGGTC TGGAGTGGGTGGCGCTGATCAACCCGTACAAGGG TGTTAGCACCTATAACCAGAAGTTCAAAGACCGT TTTACCATTAGCGTGGATAAGAGCAAAAACACCG CGTACCTGCAAATGAACAGCCTGCGTGCGGAGGA CACCGCTGTGTACTATTGCGCGCGTAGCGGTTAC TATGGCGACAGCGACTGGTATTTTGATGTGTGGG GCCAAGGCACCCTGGTTACCGTGAGCTCCGGCAC CGCCGAAGCAGCTagcgcctctGGCctgTCAggt CGTtctGATaacCATtccCCActggGTctgGCTG GGTCTCCAGGTAGCCCAGCTGGTAGCCCAACCTC TACCGAAGAAGGTACCTCTGAATCCGCTACTCCA GAATCCGGTCCTGGTACTAGCACTGAGCCAAGCG AAGGTTCTGCTCCAGGCTCCCCGGCAGGTAGCCC TACCTCTACCGAAGAGGGCACTAGCACCGAACCA TCTGAGGGTTCCGCTCCTGGCACCTCCACTGAAC CGTCCGAAGGCAGTGCTCCGGGTACTTCCGAAGA CGCAACTCCGGAATCCGGCCCTGGTTCTGAGCCT GCTACTTCCGGCTCTGAAACTCCAGGTAGCGAGC CAGCGACTTCTGGTTCTGAAACTCCAGGTTCACC GGCGGGTAGCCCGACGAGCACGGAGGAAGGTACC TCTGAGTCGGCCACTCCTGAGTCCGGTCCGGGCA CGAGCACCGAGCCGAGCGAGGGTTCAGCCCCGGG TACCAGCACGGAGCCGTCCGAGGGTAGCGCACCG GGTTCTCCGGCGGGCTCCCCTACGTCTACGGAGG AGGGTACGTCCACTGAACCTAGCGAGGGCAGCGC GCCAGGCACCAGCACTGAACCGAGCGAAGGCAGC GCACCTGGCACTAGCGAGTCTGCGACTCCGGAGA GCGGTCCGGGTACGAGCACGAACCAAGCGAAGG CAGCGCCCCAGGTACCTCTGAATCTGCTACCCCA GAATCTGGCCCGGGTTCCGAGCCAGCTACCTCTG GTTCTGAAACCCCAGGTACTTCCACTGAACCAAG CGAAGGTAGCGCTCCTGGCACTTCTACTGAACCA TCCGAAGGTTCCGCTCCTGGTACGTCTGAAAGCG CTACCCCTGAAAGCGGCCCAGGCACCTCTGAAAG CGCTACTCCTGAGAGCGGTCCAGGCTCTCCAGCA GGTTCTCCAACCTCCACTGAAGAAGGCACCTCTG AGTCTGCTACCCCTGAATCTGGTCCTGGCTCCGA ACCTGCTACCTCTGGTTCCGAAACTCCAGGTACC TCGGAATCTGCGACTCCGGAATCTGGCCCGGGCA CGAGCACGGAGCCGTCTGAGGGTAGCGCACCAGG TACCAGCACTGAGCCTTCTGAGGGCTCTGCACCG GGTACCTCCACGGAACCTTCGGAAGGTTCTGCGC CGGGTACCTCCACTGAGCCATCCGAGGGTTCAGC ACCAGGTACGAGCACCGAACCGTCCGAGGGCTCT GCACCAGGTACGAGCACCGAACCGTCCGAGGGCT CT GCGCTCCAGGTAGCCCAGCGGGCTCTCCGACAAG CACCGAAGAAGGCACCAGCACCGAGCCGTCCGAA GGTTCCGCACCAGGTACAAGCGAGAGCGCGACTC CTGAATCTGGTCCGGGTAGCGAGCCTGCAACCAG CGGTTCTGAGACGCCGGGCACTTCCGAATCTGCG ACCCCGGAGTCCGGTCCAGGTTCAGAGCCGGCGA CGAGCGGTTCGGAAACGCCGGGTACGTCTGAATC AGCCACGCCGGAGTCTGGTCCGGGTACCTCGGAG GAACCAAGCGAAGGTTCGGCACCGGGTACTAGCG AGAGCGCAACCCCTGAAAGCGGTCCGGGCAGCCC GGCAGGTTCTCCAACCAGCACCGAAGAAGGTTCC CCTGCTGGTAGCCCGACCTCTACGGAGGAAGGTA GCCCTGCAGGTTCCCAACTTCTACTGAGGAAGG | 446 |

TABLE 7-continued

T-cell binding compositions

| Construct Name | Amino Acid Sequence | SEQ ID NO: | DNA Sequence | SEQ ID NO: |
|---|---|---|---|---|
| | ATSGSETPGTSES ATPESGPGSPAGS PTSTEEGSPAGSP TSTEEGTSTEPSE GSAPGTSESATPE SGPGTSESATPES GPGTSESATPESG PGSEPATSGSETP GSEPATSGSETPG SPAGSPTSTEEGT STEPSEGSAPGTS TEPSEGSAPGSEP ATSGSETPGTSES ATPESGPGTSTEP SEGSAPGHHHHHH | | TACTTCTGAGTCCGCTACCCCAGAAAGCGGTCCT GGTACCTCCACTGAACCGTCTGAAGGCTCTGCAC CAGGCACTTCTGAGTCTGCTACTCCAGAAAGCGG CCCAGGTTCTGAACCAGCAACTTCTGGCTCTGAG ACTCCAGGCACTTCTGAGTCCGAACGCCTGAAT CCGGTCCTGGTTCTGAACCAGCTACTTCCGGCAG CGAAACCCCAGGTACCTCTGAGTCTGCGACTCCA GAGTCTGGTCCTGGTACTTCCACTGAGCCTAGCG AGGGTTCCGCACCAGGTTCTCCGGCTGGTAGCCC GACCAGCACGGAGGAGGGTACGTCTGAATCTGCA ACGCCGGAATCGGGCCCAGGTTCGGAGCCTGCAA CGTCTGGCAGCGAAACCCCGGGTACCTCCGAATC TGCTACACCGGAAAGCGGTCCTGGCAGCCCTGCT GGTTCTCCAACCTCTACCGAGGAGGGTTCACCGG CAGGTAGCCCGACTAGCACTGAAGAAGGTACTAG CACGGAGCCGAGCGAGGGTAGTGCTCCGGGTACG AGCGAGAGCGCAACGCCAGAGAGCGGTCCAGGCA CCAGCGAATCGGCCACCCCTGAGAGCGGCCCAGG TACTTCTGAGAGCGCCACTCCTGAATCCGGCCCT GGTAGCGAGCCGGCAACCTCCGGCTCAGAAACTC CTGGTTCGGAACCAGCGACCAGCGGTTCTGAAAC TCCGGGTAGCCCGGCAGGCAGCCCAACGAGCACC GAAGAGGGTACCAGCACGGAGGAACCGAGCGAGGGTT CTGCCCCGGGTACTTCCACCGAACCATCGGAGGG CTCTGCACCTGGTAGCGAACCTGCGACGTCTGGT TCTGAAACGCCGGGTACCAGCGAAAGCGCTACCC CAGAATCCGGTCCGGGCACTAGCACCGAGCCATC GGAGGGCTCCGCACCAGGTCACCATCATCACCAT CAC | |
| TBP-2 | DIQMTQSPSSLSA SVGDRVTITCRAS QDIRNYLNWYQQK PGKAPKLLIYYTS RLESGVPSRFSGS GSGTDYTLTISSL QPEDFATYYCQQG NTLPWTFGQGTKV EIKGATPPETGAE TESPGETTGGSAE SEPPGEGEVQLVE SGGGLVQPGGSLR LSCAASGYSFTGY TMNWVRQAPGKGL EWVALINPYKGVS TYNQKFKDRFTIS VDKSKNTAYLQMN SLRAEDTAVYYCA RSGYYGDSDWYFD VWGQGTLVTVSSG TAEAASASGLSGR SDNHVPLSLKMGP GSPAGSPTSTEEG TSESATPESGPGT STEPSEGSAPGSP AGSPTSTEEGTST EPSEGSAPGTSTE PSEGSAPGTSESA TPESGPGSEPATS GSETPGSEPATSG SETPGSPAGSPTS TEEGTSESATPES GPGTSTEPSEGSA PGTSTEPSEGSAP GSPAGSPTSTEEG TSTEPSEGSAPGT STEPSEGSAPGTS ESATPESGPGTST EPSEGSAPGTSES ATPESGPGSEPAT SGSETPGTSTEPS EGSAPGTSTEPSE GSAPGTSESATPE SGPGTSESATPES | 431 | GACATCCAAATGACCCAGAGCCCGAGCAGCCTGA GCGCGAGCGTGGGCGACCGTGTTACCATCACCTG CCCGTGCGAGCCAAGACATCCGTAACTACCTGAAC TGGTATCAGCAAAAGCCGGGTAAAGCGCCGAAGC TGCTGATCTACTATACCAGCCGTCTGGAGAGCGG CGTGCCGAGCCGTTTCAGCGGTAGCGGTAGCGGT ACCGACTACACCCTGACCATTAGCAGCCTGCAGC CGGAAGATTTCGCGACCTACTATTGCCAGCAGGG TAACACCCTGCCGTGGACCTTTGGTCAAGGCACC AAAGTTGAGATTAAAGGCGCCACGCCTCCGGAAA CTGGTGCTGAGACGGAATCCCCTGGTGAAACCAC TGGCGGTTCTGCCGAATCTGAACCGCCTGGTGAA GGCGAGGTGCAGCTGGTTGAAAGCGGTGGCGGTC TGGTGCAACCAGGCGGTAGCCTGCGTCTGAGCTG CGCGGCGAGCGGTTACAGCTTTACCGGTTATACC ATGAACTGGGTTCGTCAAGCGCAGGTAAAGGTC TGGAGTGGGTGGCGCTGATCAACCCGTACAAGGG TGTTAGCACCTATAACCAGAAGTTCAAAGACCGT TTTACCATTAGCGTGGATAAGAGCAAAAACACCG CGTACCTGCAAATGAACAGCCTGCGTGCGGAGGA CACCGCTGTGTACTATTGCGCGCGTAGCGGTTAC TATGGCGACAGCGACTGGTATTTTGATGTGTGGG GCCAAGGCACCCTGGTTACCGTGAGCTCCGGCAC CGCCGAAGCAGCTagcgcctctGGCctgTCAggt CGTtctGATaacCATgttCCActgTCTctgAAAa tgGGTCCAGGTAGCCCAGCTGGTAGCCCAACCTC TACCGAAGAAGGTACCTCTGAATCCGCTACTCCA GAATCCGGTCCTGGTACTAGCACTGAGCCAAGCG AAGGTTCTGCTCCAGGCTCCCCGGCAGGTAGCCC TACCTCTACCGAAGAGGGCACTAGCACCGAACCA TCTGAGGGTTCCGCTCCTGGCACCTCCACTGAAC CGTCCGAAGGCAGTGCTCCGGGTACTTCCGAAAG CGCAACTCCGGAATCCGGCCCTGGTTCTGAGCCT GCTACTTCCGGCTCTGAAACTCCAGGTAGCGAGC CAGCGACTTCTGGTTCTGAAACTCCAGGTTCACC GGCGGGTAGCCCGACGAGCACGGAGGAAGGTACC TCTGAGTCGGCCACTCCTGAGTCCGGTCCGGGCA CGAGCACCGAGCCGAGCGAGGGTTCAGCCCGGG TACCAGCACGGAGCCGTCCGAGGGTAGCGCACCG GGTTCTCCGGCGGGCTCCCCTACGTCTACGGAAG AGGGTACGTCCACTGAACCTAGCGAGGGCAGCGC GCCAGGCACCAGCACTGAACCGAGCGAAGGCAGC GCACCTGGCACTAGCGAGTCTGCGACTCCGGAGA GCGGTCCGGGTACGAGCACGGAACCAAGCGAAGG | 447 |

TABLE 7-continued

T-cell binding compositions

| Construct Name | Amino Acid Sequence | SEQ ID NO: | DNA Sequence | SEQ ID NO: |
|---|---|---|---|---|
| | GPGSPAGSPTSTE EGTSESATPESGP GSEPATSGSETPG TSESATPESGPGT STEPSEGSAPGTS TEPSEGSAPGTST EPSEGSAPGTSTE PSEGSAPGTSTEP SEGSAPGTSTEPS EGSAPGSPAGSPT STEEGTSTEPSEG SAPGTSESATPES GPGSEPATSGSET PGTSESATPESGP GSEPATSGSETPG TSESATPESGPGT STEPSEGSAPGTS ESATPESGPGSPA GSPTSTEEGSPAG SPTSTEEGSPAGS PTSTEEGTSESAT PESGPGTSTEPSE GSAPGTSESATPE SGPGSEPATSGSE TPGTSESATPESG PGSEPATSGSETP GTSESATPESGPG TSTEPSEGSAPGS PAGSPTSTEEGTS ESATPESGPGSEP ATSGSETPGTSES ATPESGPGSPAGS PTSTEEGSPAGSP TSTEEGTSTEPSE GSAPGTSESATPE SGPGTSESATPES GPGTSESATPESG PGSEPATSGSETP GSEPATSGSETPG SPAGSPTSTEEGT STEPSEGSAPGTS TEPSEGSAPGSEP ATSGSETPGTSES ATPESGPGTSTEP SEGSAPGHHHHHH | | CAGCGCCCCAGGTACCTCTGAATCTGCTACCCCA GAATCTGGCCCGGGTTCCGAGCCAGCTACCTCTG GTTCTGAAACCCCAGGTACTTCCACTGAACCAAG CGAAGGTAGCGCTCCTGGCACTTCTACTGAACCA TCCGAAGGTTCCGCTCCTGGTACGTCTGAAAGCG CTACCCCTGAAAGCGGCCCAGGCACCTCTGAAAG CGCTACTCCTGAGAGCGGTCCAGGCTCTCCAGCA GGTTCTCCAACCTCCACTGAAGAAGGCACCTCTG AGTCTGCTACCCCTGAATCTGGTCCTGGCTCCGA ACCTGCTACCTCTGGTTCCGAAACTCCAGGTACC TCGGAATCTGCGACTCCGGAATCTGGCCCGGCA CGAGCACGGAGCCGTCTGAGGGTAGCGCACCAGG TACCAGCACTGAGCCTTCTGAGGGCTCTGCACCG GGTACCTCCACGGAACCTTCGGAAGGTTCTGCGC CGGGTACCTCCACTGAGCCATCCGAGGGTTCAGC ACCAGGTACTAGCACGGAACCGTCCGAGGGCTCT GCACCAGGTACGAGCACCGAACCGTCGGAGGGTA GCGCTCCAGGTAGCCCAGCGGGCTCTCCGACAAG CACCGAAGAAGGCACCAGCACCGAGCCGTCCGAA GGTTCCGCACCAGGTACAAGCGAGAGCGCGACTC CTGAATCTGGTCCGGGTAGCGAGCCTGCAACCAG CGGTTCTGAGACGCCGGGCACTTCCGAATCTGCG ACCCCGGGAGTCCGGTCCAGGTTCAGAGCCGGCGA CGAGCGGTTCGGAAACGCCGGGTACGTCTGAATC AGCCACGCCGGAGTCTGGTCCGGGTACCTCGACC GAACCAAGCGAAGGTTCGGCACCGGGTACTAGCG AGAGCGCAACCCCTGAAAGCGGTCCGGGCAGCCG GGCAGGTTCTCCAACCAGCACCGAAGAAGGTTCC CCTGCTGGTAGCCCGACCTCTACGGAGGAAGGTA GCCCTGCAGGTTCCCCAACTTCTACTGAGGAAGG TACTTCTGAGTCCGCTACCCCAGAAAGCGGTCCT GGTACCTCCACTGAACCGTCTGAAGGCTCTGCAC CAGGCACTTCTGAGTCTGCTACTCCAGAAAGCGG CCCAGGTTCTGAACCAGCAACTTCTGGCTCTGAG ACTCCAGGCACTTCTGAGTCCGAACGCCTGAAT CCGGTCCTGGTTCTGAACCAGCTACTTCCGGCAG CGAAACCCCAGGTACCTCTGAGTCTGCGACTCCA GAGTCTGGTCCTGGTACTTCCACTGAGCCTAGCG AGGGTTCCGCACCAGGTTCTCCGGCTGGTAGCCC GACCAGCACGGAGGAGGGTACGTCTGAATCTGCA ACGCCGGAATCGGGCCCAGGTTCGGAGCCTGCAA CGTCTGGCAGCGAAACCCCGGGTACCTCCGAATC TGCTACACCGGAAAGCGGTCCTGGCAGCCCTGCT GGTTCTCCAACCTCTACCGAGGAGGGTTCACCGG CAGGTAGCCCGACTAGCACTGAAGAAGGTACTAG CACGGAGCCGAGCGAGGGTAGTGCTCCGGGTACG AGCGAGAGCGCAACGCCAGAGAGCGGTCCAGGCA CCAGCGAATCGGCCACCCCTGAGAGCGGCCCAGG TACTTCTGAGAGCGCCACTCCTGAATCCGGCCCT GGTAGCGAGCCGGCAACCTCCGGCTCAGAAACTC CTGGTTCGGAACCAGCGACCAGCGGTTCTGAAAC TCCGGGTAGCCCGGCAGGCAGCCCAACGAGCACC GAAGAGGGTACCAGCACGGAACCGAGCGAGGGTT CTGCCCCGGGTACTTCCACCGAACCATCGGAGGG CTCTGCACCTGGTAGCGAACCTGCGACGTCTGGT TCTGAAACGCCGGGTACCAGCGAAAGCGCTACCC CAGAATCCGGTCCGGGCACTAGCACCGAGCCATC GGAGGGCTCCGCACCAGGTCACCATCATCACCAT CAC | |
| TBP-3 | EVQLVESGGGLVQ PGGSLRLSCAASG YSFTGYTMNWVRQ APGKGLEWVALIN PYKGVSTYNQKFK DRFTISVDKSKNT AYLQMNSLRAEDT AVYYCARSGYYGD SDWYFDVWGQGTL VTVSSGATPPETG AETESPGETTGGS AESEPPGEGDIQM TQSPSSLSASVGD RVTITCRASQDIR | 432 | GAGGTGCAGCTGGTTGAAAGCGGTGGCGGTCTGG TGCAACCAGGCGGTAGCCTGCGTCTGAGCTGCGC GGCGAGCGGTTACAGCTTTACCGGTTATACCATG AACTGGGTTCGTCAAGCGCCAGGTAAAGGTCTGG AGTGGGTGGCGCTGATCAACCCCGTACAAGGGTGT TAGCACCTATAACCAGAAGTTCAAAGACCGTTTT ACCATTAGCGTGGATAAGAGCAAAAACACCGCGT ACCTGCAAATGAACAGCCTGCGTGCGGAGGACAC CGCTGTGTACTATTGCGCGCGTAGCGGTTACTAT GGCGACAGCGACTGGTATTTTGATGTGTGGGGCC AAGGCACCCTGGTTACCGTGAGCTCCGGCGCCAC GCCTCCGGAAACTGGTGCTGAGACGGAATCCCCT GGTGAAACCACTGGCGGTTCTGCCGAATCTGAAC CGCCTGGTGAAGGCGACATCCAAATGACCCAGAG | 448 |

TABLE 7-continued

T-cell binding compositions

| Construct Name | Amino Acid Sequence | SEQ ID NO: | DNA Sequence | SEQ ID NO: |
|---|---|---|---|---|
| | NYLNWYQQKPGKA | | CCCGAGCAGCCTGAGCGCGAGCGTGGGCGACCGT | |
| | PKLLIYYTSRLES | | GTTACCATCACCTGCCGTGCGCAAGACATCC | |
| | GVPSRFSGSGSGT | | GTAACTACCTGAACTGGTATCAGCAAAAGCCGGG | |
| | DYTLTISSLQPED | | TAAAGCGCCGAAGCTGCTGATCTACTATACCAGC | |
| | FATYYCQQGNTLP | | CGTCTGGAGAGCGGCGTGCCGAGCCGTTTCAGCG | |
| | WTFGQGTKVEIKG | | GTAGCGGTAGCGGTACCGACTACACCCTGACCAT | |
| | TAEAASASGLSGR | | TAGCAGCCTGCAGCCGGAAGATTTCGCGACCTAC | |
| | SDNHSPLGLAGSP | | TATTGCCAGCAGGGTAACACCCTGCCGTGGACCT | |
| | GSPAGSPTSTEEG | | TTGGTCAAGGCACCAAAGTTGAGATTAAAGGCAC | |
| | TSESATPESGPGT | | CGCCGAAGCAGCTagcgcctctGGCctgTCAggt | |
| | STEPSEGSAPGSP | | CGTtctGATaacCATtccCCActgGGTctgGCTG | |
| | AGSPTSTEEGTST | | GGTCTCCAGGTAGCCCAGCTGGTAGCCCAACCTC | |
| | EPSEGSAPGTSTE | | TACCGAAGAAGGTACCTCTGAATCCGCTACTCCA | |
| | PSEGSAPGTSESA | | GAATCCGGTCCTGGTACTAGCACTGAGCCAAGCG | |
| | TPESGPGSEPATS | | AAGGTTCTGCTCCAGGCTCCCCGGCAGGTAGCCC | |
| | GSETPGSEPATSG | | TACCTCTACCGAAGAGGGCACTAGCACCGAACCA | |
| | SETPGSPAGSPTS | | TCTGAGGGTTCCGCTCCTGGCACCTCCACTGAAC | |
| | TEEGTSESATPES | | CGTCCGAAGGCAGTGCTCCGGGTACTTCCGAAAG | |
| | GPGTSTEPSEGSA | | CGCAACTCCGGAATCCGGCCCTGGTTCTGAGCCT | |
| | PGTSTEPSEGSAP | | GCTACTTCCGGCTCTGAAACTCCAGGTAGCGAGC | |
| | GSPAGSPTSTEEG | | CAGCGACTTCTGGTTCTGAAACTCCAGGTTCACC | |
| | TSTEPSEGSAPGT | | GGCGGGTAGCCCGACGAGCACGGAGGAAGGTACC | |
| | STEPSEGSAPGTS | | TCTGAGTCGGCCACTCCTGAGTCCGGTCCGGGCA | |
| | ESATPESGPGTST | | CGAGCACCGAGCCGAGCGAGGGTTCAGCCCCGGG | |
| | EPSEGSAPGTSES | | TACCAGCACGGAGCCGTCCGAGGGTAGCGCACCG | |
| | ATPESGPGSEPAT | | GGTTCTCCGGCGGGCTCCCCTACGTCTACGGAAG | |
| | SGSETPGTSTEPS | | AGGGTACGTCCACTGAACCTAGCGAGGGCAGCGC | |
| | EGSAPGTSTEPSE | | GCCAGGCACCAGCACTGAACCGAGCGAAGGCAGC | |
| | GSAPGTSESATPE | | GCACCTGGCACTAGCGAGTCTGCGACTCCGGCAA | |
| | SGPGTSESATPES | | GCGGTCCGGGTACGAGCACGGAACCAAGCGAAGG | |
| | GPGSPAGSPTSTE | | CAGCGCCCCAGGTACCTCTGAATCTGCTACCCCA | |
| | EGTSESATPESGP | | GAATCTGGCCCGGGTTCCGAGCCAGCTACCTCTG | |
| | GSEPATSGSETPG | | GTTCTGAAACCCCAGGTACTTCCACTGAACCAAG | |
| | TSESATPESGPGT | | CGAAGGTAGCGCTCCTGGCACTTCTACTGAACCA | |
| | STEPSEGSAPGTS | | TCCGAAGGTTCCGCTCCTGGTACGTCTGAAAGCG | |
| | TEPSEGSAPGTST | | CTACCCCTGAAAGCGGCCCAGGCACCTCTGAAAG | |
| | EPSEGSAPGTSTE | | CGCTACTCCTGAGAGCGGTCCAGGCTCTCCAGCA | |
| | PSEGSAPGTSTEP | | GGTTCTCCAACCTCCACTGAAGAAGGCACCTCTG | |
| | SEGSAPGTSTEPS | | AGTCTGCTACCCCTGAATCTGGTCCTGGCTCCGA | |
| | EGSAPGSPAGSPT | | ACCTGCTACCTCTGGTTCCGAAACTCCAGGTACC | |
| | STEEGTSTEPSEG | | TCGGAATCTGCGACTCCGGAATCTGGCCCGGGCA | |
| | SAPGTSESATPES | | CGAGCACGGAGCCGTCTGAGGGTAGCGCACCAGG | |
| | GPGSEPATSGSET | | TACCAGCACTGAGCCTTCTGAGGGCTCTGCACCG | |
| | PGTSESATPESGP | | GGTACCTCCACGGAACCTTCGGAAGGTTCTGCGC | |
| | GSEPATSGSETPG | | CGGGTACCTCCACTGAGCCATCCGAGGGTTCAGC | |
| | TSESATPESGPGT | | ACCAGGTACTAGCACGGAACCGTCCGAGGGCTCT | |
| | STEPSEGSAPGTS | | GCACCAGGTACGAGCACCGAACCGTCGGAGGGTA | |
| | ESATPESGPGSPA | | GCGCTCCAGGTAGCCCAGCGGGCTCTCCGACAAG | |
| | GSPTSTEEGSPAG | | CACCGAAGAAGGCACCAGCACCGAGCCGTCCGAA | |
| | SPTSTEEGSPAGS | | GGTTCCGCACCAGGTACAAGCGAGGCGACTC | |
| | PTSTEEGTSESAT | | CTGAATCTGGTCCGGGTAGCGAGCCTGCAACCAG | |
| | PESGPGTSTEPSE | | CGGTTCTGAGACGCCGGGCACTTCCGAATCTGCG | |
| | GSAPGTSESATPE | | ACCCCGGAGTCCGGTCCAGGTTCAGAGCCGGCGA | |
| | SGPGSEPATSGSE | | CGAGCGGTTCGGAAACGCCGGGTACGTCTGAATC | |
| | TPGTSESATPESG | | AGCCACGCCGGAGTCTGGTCCGGGTACCTCGACC | |
| | PGSEPATSGSETP | | GAACCAAGCGAAGGTTCGGCACCGGGTACTAGCG | |
| | GTSESATPESGPG | | AGAGCGCAACCCCTGAAAGCGGTCCGGGCAGCCC | |
| | TSTEPSEGSAPGS | | GGCAGGTTCTCCAACCAGCACCGAAGAAGGTTCC | |
| | PAGSPTSTEEGTS | | CCTGCTGGTAGCCCGACCTCTACGGAGGAAGGTA | |
| | ESATPESGPGSEP | | GCCCTGCAGGTTCCCCAACTTCTACTGAAGAAGG | |
| | ATSGSETPGTSES | | TACTTCTGAGTCCGCTACCCCAGAAAGCGGTCCT | |
| | ATPESGPGSPAGS | | GGTACCTCCACTGAACCGTCTGAAGGCTCTGCAC | |
| | PTSTEEGSPAGSP | | CAGGCACTTCTGAGTCTGCTACTCCAGAAAGCGG | |
| | TSTEEGTSTEPSE | | CCCAGGTTCTGAACCAGCAACTTCTGGCTCTGAG | |
| | GSAPGTSESATPE | | ACTCCAGGCACTTCTGAGTCCGCAACGCCTGAAT | |
| | SGPGTSESATPES | | CCGGTCCTGGTTCTGAACCAGCTACTTCCGGCAG | |
| | GPGTSESATPESG | | CGAAACCCCAGGTACCTCTGAGTCTGCGACTCCA | |
| | PGSEPATSGSETP | | GAGTCTGGTCCTGGTACTTCCACTGAGCCTAGCG | |
| | GSEPATSGSETPG | | AGGGTTCCGCACCAGGTTCTCCGGCTGGTAGCCC | |
| | SPAGSPTSTEEGT | | GACCAGCACGGAGGAGGGTACGTCTGAATCTGCA | |
| | STEPSEGSAPGTS | | ACGCCGGAATCGGGCCCAGGTTCGGAGCCTGCAA | |

TABLE 7-continued

T-cell binding compositions

| Construct Name | Amino Acid Sequence | SEQ ID NO: | DNA Sequence | SEQ ID NO: |
|---|---|---|---|---|
| | TEPSEGSAPGSEP ATSGSETPGTSES ATPESGPGTSTEP SEGSAPGHHHHHH | | CGTCTGGCAGCGAAACCCCGGGTACCTCCGAATC TGCTACACCGGAAAGCGGTCCTGGCAGCCCTGCT GGTTCTCCAACCTCTACCGAGGAGGGTTCACCGG CAGGTAGCCCGACTAGCACTGAAGAAGGTACTAG CACGGAGCCGAGCGAGGGTAGTGCTCCGGGTACG AGCGAGAGCGCAACGCCAGAGAGCGGTCCAGGCA CCAGCGAATCGGCCACCCCTGAGAGCGGCCCAGG TACTTCTGAGAGCGCCACTCCTGAATCCGGCCCT GGTAGCGAGCCGGCAACCTCCGGCTCAGAAACTC CTGGTTCGGAACCAGCGACCAGCGGTTCTGAAAC TCCGGGTAGCCCGGCAGGCAGCCCAACGAGCACC GAAGAGGGTACCAGCACGGAACCGAGCGAGGGTT CTGCCCCGGGTACTTCCACCGAACCATCGGAGGG CTCTGCACCTGGTAGCGAACCTGCGACGTCTGGT TCTGAAACGCCGGGTACCAGCGAAAGCGCTACCC CAGAATCCGGTCCGGGCACTAGCACCGAGCCATC GGAGGGCTCCGCACCAGGTCACCATCATCACCAT CAC | |
| TBP-4 | EVQLVESGGGLVQ PGGSLRLSCAASG YSFTGYTMNWVRQ APGKGLEWVALIN PYKGVSTYNQKFK DRFTISVDKSKNT AYLQMNSLRAEDT AVYYCARSGYYGD SDWYFDVWGQGTL VTVSSGATPPETG AETESPGETTGGS AESEPPGEGDIQM TQSPSSLSASVGD RVTITCRASQDIR NYLNWYQQKPGKA PKLLIYYTSRLES GVPSRFSGSGSGT DYTLTISSLQPED FATYYCQQGNTLP WTFGQGTKVEIKG TAEAASASGLSGR SDNHVPLSLKMGP GSPAGSPTSTEEG TSESATPESGPGT STEPSEGSAPGSP AGSPTSTEEGTST EPSEGSAPGTSTE PSEGSAPGTSESA TPESGPGSEPATS GSETPGSEPATSG SETPGSPAGSPTS TEEGTSESATPES GPGTSTEPSEGSA PGTSTEPSEGSAP GSPAGSPTSTEEG TSTEPSEGSAPGT STEPSEGSAPGTS ESATPESGPGTST EPSEGSAPGTSES ATPESGPGSEPAT SGSETPGTSTEPS EGSAPGTSTEPSE GSAPGTSESATPE SGPGTSESATPES GPGSPAGSPTSTE EGTSESATPESGP GSEPATSGSETPG TSESATPESGPGT STEPSEGSAPGTS TEPSEGSAPGTST EPSEGSAPGTSTE PSEGSAPGTSTEP SEGSAPGTSTEPS EGSAPGSPAGSPT STEEGTSTEPSEG | 433 | GAGGTGCAGCTGGTTGAAAGCGGTGGCGGTCTGG TGCAACCAGGCGGTAGCCTGCGTCTGAGCTGCGC GGCAGCGGTTACAGCTTTACCGGTTATACCATG AACTGGGTTCGTCAAGCGCCAGGTAAAGGTCTGG AGTGGGTGGCGCTGATCAACCCGTACAAGGGTGT TAGCACCTATAACCAGAAGTTCAAAGACCGTTTT ACCATTAGCGTGGATAAGAGCAAAAACACCGCGT ACCTGCAAATGAACAGCCTGCGTGCGGAGGACAC CGCTGTGTACTATTGCGCGCGTAGCGGTTACTAT GGCGACAGCGACTGGTATTTTGATGTGTGGGGCC AAGGCACCCTGGTTACCGTGAGCTCCGGCGCCAC GCCTCCGGGAAACTGGTGCTGAGACGGAATCCCCT GGTGAAACCACTGGCGGTTCTGCCGAATCTGAAC CGCCTGGTGAAGGCGACATCCAAATGACCCAGAG CCCGAGCAGCCTGAGCGCGAGCGTGGGCGACCGT GTTACCATCACCTGCCGTGCGAGCCAAGACATCC GTAACTACCTGAACTGGTATCAGCAAAAGCCGGG TAAAGCGCCGAAGCTGCTGATCTACTATACCAGC CGTCTGGAGAGCGGCGTGCCGAGCCGTTTCAGCG GTAGCGGTAGCGGTACCGACTACACCCTGACCAT TAGCAGCCTGCAGCCGGAAGATTTCGCGACCTAC TATTGCCAGCAGGGTAACACCCTGCCGTGGACCT TTGGTCAAGGCACCAAAGTTGAGATTAAAGGCAC CGCCGAAGCAGCTagcgcctctGGCctgTCAggt CGTtctGATaacCATgttCCActgTCTctgAAAa tgGGTCCAGGTAGCCCAGCTGGTAGCCCAACCTC TACCGAAGAAGGTACTTCTGAATCCGCTACTCCA GAATCCGGTCCTGGTACTAGCACTGAGCCAAGCG AAGGTTCTGCTCCAGGCTCCCCGGCAGGTAGCCC TACCTCTACCGAAGAGGGCACTAGCACCGAACCA TCTGAGGGTTCCGCTCCTGGCACCTCCACTGAAC CGTCCGAAGGCAGTGCTCCGGGTACTTCCGAAAG CGCAACTCCGGAATCCGGCCCTGGTTCTGAGCCT GCTACTTCCGGCTCTGAAACTCCAGGTAGCGAGC CAGCGACTTCTGGTTCTGAAACTCCAGGTTCACC GGCGGGTAGCCCGACGAGCACGGAGGAAGGTACC TCTGAGTCGGCCACTCCTGAGTCCGGTCCGGGCA CGAGCACCGAGCCGAGCGAGGGTTCAGCCGGCA TACCAGCACGGAGCCGTCCGAGGGTAGCGCACCG GGTTCTCCGGCGGGCTCCCCTACGTCTACGGAAG AGGGTACGTCCACTGAACCTAGCGAGGGCAGCGC GCCAGGCACCAGCACTGAACCGAGCGAAGGTACC GCACCTGGCACTAGCGAGTCTGCGACTCCGGAGA GCGGTCCGGGTACGAGCACGGAACCAAGCGAAGG CAGCGCCCCAGGTACCTCTGAATCTGCTACCCCA GAATCTGGCCCGGGTTCCGAGCCAGCTACCTCTG GTTCTGAAACCCCAGGTACTTCCACTGAACCAAG CGAAGGTAGCGCTCCTGGCACTTCTACTGAACCA TCCGAAGGTTCCGCTCCTGGTACGTCTGAAAGCG CTACCCCTGAAAGCGGCCCAGGCACCTCTGAAAG CGCTACTCCTGAGAGCGGTCCAGGCTCTCCAGCA GGTTCTCCAACCTCCACTGAAGAAGGCACCCTG AGTCTGCTACCCCTGAATCTGGTCCTGGCTCCGA ACCTGCTACCTCTGGTTCCGAAACTCCAGGTACC TCGGAATCTGCGACTCCGGAATCTGGCCCGGGCA | 449 |

TABLE 7-continued

T-cell binding compositions

| Construct Name | Amino Acid Sequence | SEQ ID NO: | DNA Sequence | SEQ ID NO: |
|---|---|---|---|---|
| | SAPGTSESATPES GPGSEPATSGSET PGTSESATPESGP GSEPATSGSETPG TSESATPESGPGT STEPSEGSAPGTS ESATPESGPGSPA GSPTSTEEGSPAG SPTSTEEGSPAGS PTSTEEGTSESAT PESGPGTSTEPSE GSAPGTSESATPE SGPGSEPATSGSE TPGTSESATPESG PGSEPATSGSETP GTSESATPESGPG TSTEPSEGSAPGS PAGSPTSTEEGTS ESATPESGPGSEP ATSGSETPGTSES ATPESGPGSPAGS PTSTEEGSPAGSP TSTEEGTSTEPSE GSAPGTSESATPE SGPGTSESATPES GPGTSESATPESG PGSEPATSGSETP GSEPATSGSETPG SPAGSPTSTEEGT STEPSEGSAPGTS TEPSEGSAPGSEP ATSGSETPGTSES ATPESGPGTSTEP SEGSAPGHHHHHH | | CGAGCACGGAGCCGTCTGAGGGTAGCGCACCAGG TACCCAGCACTGAGCCTTCTGAGGGCTCTGCACCG GGTACCTCCACGGAACCTTCGGAAGGTTCTGCGC CGGGTACCTCCACTGAGCCATCCGAGGGTTCAGC ACCAGGTACTAGCACGGAACCGTCCGAGGGCTCT GCACCAGGTACGAGCACCGAACCGTCGGAGGGTA GCGCTCCAGGTAGCCCAGCGGGCTCTCCGACAAG CACCGAAGAAGGCACCAGCACCGAGCCGTCCGAA GGTTCCGCACCAGGTACAAGCGAGAGCGCGACTC CTGAATCTGGTCCGGGTAGCGAGCCTGCAACCAG CGGTTCTGAGACGCCGGGCACTTCCGAATCTGCA ACCCCGGAGTCCGGTCCAGGTTCAGAGCCGGCGA CGAGCGGTTCGGAAACGCCGGGTACGTCTGAATC AGCCACGCCGGAGTCTGGTCCGGGTACCTCGACC GAACCAAGCGAAGGTTCGGCACCGGGTACTAGCG AGAGCGCAACCCCTGAAAGCGGTCCGGGCAGCCC GGCAGGTTCTCCAACCAGCACCGAAGAAGGTTCC CCTGCTGGTAGCCCGACCTCTACGGAGGAAGGTA GCCCTGCAGGTTCCCCAACTTCTACTGAGGAAGG TACTTCTGAGTCCGCTACCCCAGAAAGCGGTCCT GGTACCTCCACTGAACCGTCTGAAGGCTCTGCAC CAGGCACTTCTGAGTCTGCTACTCCAGAAAGCGG CCCAGGTTCTGAACCAGCAACTTCTGGCTCTGAG ACTCCAGGCACTTCTGAGTCCGCAACGCCTGAAT CCGGTCCTGGTTCTGAACCAGCTACTTCCGGCAG CGAAACCCCAGGTACCTCTGAGTCTGCGACTCCA GAGTCTGGTCCTGGTACTTCCACTGAGCCTAGCG AGGGTTCCGCACCAGGTTCTCCGGCTGGTAGCCC GACCAGCACGGAGGAGGGTACGTCTGAATCTGCA ACGCCGGAATCGGGCCCAGGTTCGGAGCCTGCAA CGTCTGGCAGCGAAACCCCGGGTACCTCCGAATC TGCTACACCGGAAAGCGGTCCTGGCAGCCCTGCT GGTTCTCCAACCTCTACCGAGGAGGTTCACCGG CAGGTAGCCCGACTAGCACTGAAGAAGGTACTAG CACGGAGCCAGCGAGGGTAGTGCTCCGGGTACG AGCGAGAGCGCAACGCCAGAGAGCGGTCCAGGCA CCAGCGAATCGGCCACCCCTGAGAGCGGCCCAGG TACTTCTGAGAGCGCCACTCCTGAATCCGGCCCT GGTAGCGAGCCGGCAACCTCCGGCTCAGAAACTC CTGGTTCGGAACCAGCGACCAGCGGTTCTGAAAC TCCGGGTAGCCCGGCAGGCAGCCCAACGAGCACC GAAGAGGGTACCAGCACGGAACCGAGCGAGGGTT CTGCCCCGGGTACTTCCACCGAACCATCGGAGGG CTCTGCACCTGGTAGCGAACCTGCGACGTCTGGT TCTGAAACGCCGGGTACCAGCGAAAGCGCTACCC CAGAATCCGGTCCGGGCACTAGCACCGAGCCATC GGAGGGCTCCGCACCAGGTCACCATCATCACCAT CAC | |
| TBP-5 | ELVVTQEPSLTVS PGGTVTLTCRSST GAVTTSNYANWVQ QKPGQAPRGLIGG TNKRAPGTPARFS GSLLGGKAALTLS GVQPEDEAEYYCA LWYSNLWVFGGGT KLTVLGATPPETG AETESPGETTGGS AESEPPGEGEVQL LESGGGLVQPGGS LKLSCAASGFTFN TYAMNWVRQAPGK GLEWVARIRSKYN NYATYYADSVKDR FTISRDDSKNTAY LQMNNLKTEDTAV YYCVRHGNFGNSY VSWFAYWGQGTLV TVSSGTAEAASAS GLSGRSDNHSPLG LAGSPGSPAGSPT STEEGTSESATPE SGPGTSTEPSEGS | 434 | GAACTGGTCGTCACGCAGGAGCCGTCCCTTACCG TTTCACCAGGTGGAACAGTGACTCTGACGTGTCG CTCCTCCACTGGGGCGGTTACAACTTCCAATTAT GCTAATTGGGTCCAGCAGAAGCCGGGCCAAGCCC CTCGCGGGTTGATTGGCGGCACCAACAAACGTGC TCCAGGGACACCTGCCCGTTTTTCGGGCTCCTTA TTGGGGGCAAAGCTGCACTGACGTTGTCTGGAG TTCAGCCGGAGGATGAGGCAGAGTATTACTGCGC ATTGTGGTATTCTAATTTATGGGTTTTTGGAGGC GGCACAAAGCTGACCGTCCTGggtgcgaccccgc cggaaaccggtgcggaaaccgaaagcccgggtga aaccaccggtggcagcgcggagagcgaaccgccg ggtgaaggtGAGGTTCAGTTGTTGGAAAGCGGGG GCGGGCTTGTCCAACCTGGAGGTTCATTAAAATT GAGCTGTGCAGCCTCCGGATTCACCTTTAACACG TATGCAATGAACTGGGTCCGTCAAGCGCCCGGTA AGGGGCTGGAGTGGGTAGCTCGCATCCGCTCGAA GTATAATAATTACGCAACCTACTACGCAGACAGT GTCAAAGATCGCTTCACTATCTCACGCGACGACA GTAAGAACACGGCCTACTTACAGATGAACAATCT TAAAACGGAGGACACCGCTGTCTACTACTGCGTG CGCCACGGGAATTTCGGTAACTCTTATGTAAGTT GGTTCGCATATTGGGGACAAGGTACGTTGGTAAC CGTATCCAGCGGCACCGCCGAAGCAGCTagcgcc tctGGCctgTCAggtCGTtctGATaacCATtccC | 450 |

TABLE 7-continued

T-cell binding compositions

| Construct Name | Amino Acid Sequence | SEQ ID NO: | DNA Sequence | SEQ ID NO: |
|---|---|---|---|---|
| | APGSPAGSPTSTE EGTSTEPSEGSAP GTSTEPSEGSAPG TSESATPESGPGS EPATSGSETPGSE PATSGSETPGSPA GSPTSTEEGTSES ATPESGPGTSTEP SEGSAPGTSTEPS EGSAPGSPAGSPT STEEGTSTEPSEG SAPGTSTEPSEGS APGTSESATPESG PGTSTEPSEGSAP GTSESATPESGPG SEPATSGSETPGT STEPSEGSAPGTS TEPSEGSAPGTSE SATPESGPGTSES ATPESGPGSPAGS PTSTEEGTSESAT PESGPGSEPATSG SETPGTSESATPE SGPGTSTEPSEGS APGTSTEPSEGSA PGTSTEPSEGSAP GTSTEPSEGSAPG TSTEPSEGSAPGT STEPSEGSAPGSP AGSPTSTEEGTST EPSEGSAPGTSES ATPESGPGSEPAT SGSETPGTSESAT PESGPGSEPATSG SETPGTSESATPE SGPGTSTEPSEGS APGTSESATPESG PGSPAGSPTSTEE GSPAGSPTSTEEG SPAGSPTSTEEGT SESATPESGPGTS TEPSEGSAPGTSE SATPESGPGSEPA TSGSETPGTSESA TPESGPGSEPATS GSETPGTSESATP ESGPGTSTEPSEG SAPGSPAGSPTST EEGTSESATPESG PGSEPATSGSETP GTSESATPESGPG SPAGSPTSTEEGS PAGSPTSTEEGTS TEPSEGSAPGTSE SATPESGPGTSES ATPESGPGTSESA TPESGPGSEPATS GSETPGSEPATSG SETPGSPAGSPTS TEEGTSTEPSEGS APGTSTEPSEGSA PGSEPATSGSETP GTSESATPESGPG TSTEPSEGSAPGH HHHHH | | CActgGGTctgGCTGGGTCTCCAGGTAGCCCAGC TGGTAGCCCAACCTCTACCGAAGAAGGTACCTCT GAATCCGCTACTCCAGAATCCGGTCCTGGTACTA GCACTGAGCCAAGCGAAGGTTCTGCTCCAGGCTC CCCGGCAGGTAGCCCTACCTCTACCGAAGAGGGC ACTAGCACCGAACCATCTGAGGGTTCCGCTCCTG GCACCTCCACTGAACCGTCCGAAGGCAGTGCTCC GGGTACTTCCGAAAGCGCAACTCCGGAATCCGGC CCTGGTTCTGAGCCTGCTACTTCCGGCTCTGAAA CTCCAGGTAGCGAGCCAGCGACTTCTGGTTCTGA AACTCCAGGTTCACCGGCGGGTAGCCCGACGAGC ACGGAGGAAGGTACCTCTGAGTCGGCCACTCCTG AGTCCGGTCCGGGCACGAGCACCGAGCCGAGCGA GGGTTCAGCCCCGGGTACCAGCACGGAGCCGTCC GAGGGTAGCGCACCGGGTTCTCCGGCGGGCTCCC CTACGTCTACGGAAGAGGGTACGTCCACTGAACC TAGCGAGGGCAGCGCGCCAGGCACCAGCACTGAA CCGAGCGAAGGCAGCGCACCTGGCACTAGCGAGT CTGCGACTCCGGAGAGCGGTCCGGGTACGAGCGA GGAACCAAGCGAAGGCAGCGCCCCAGGTACCTCT GAATCTGCTACCCCAGAATCTGGCCCGGGTTCCG AGCCAGCTACCTCTGGTTCTGAAACCCCAGGTAC TTCCACTGAACCAAGCGAAGGTAGCGCTCCTGGC ACTTCTACTGAACCATCCGAAGGTTCCGCTCCTG GTACGTCTGAAAGCGCTACCCCTGAAAGCGGCCC AGGCACCTCTGAAAGCGCTACTCCTGAGAGCGGT CCAGGCTCTCCAGCAGGTTCTCCAACCTCCACTG AAGAAGGCACCTCTGAGTCTGCTACCCCTGAATC TGGTCCTGGCTCCGAACCTGCTACCTCTGGTTCC GAAACTCCAGGTACCTCGGAATCTGCGACTCCGG AATCTGGCCCGGGCACGAGCACGGAGCCGTCTGA GGGTAGCGCACCAGGTACCAGCACTGAGCCTTCT GAGGGCTCTGCACCGGGTACCTCCACGGAACCTT CGGAAGGTTCTGCGCCGGGTACCTCCACTGAGCC ATCCGAGGGTTCAGCACCAGGTACTAGCACGGAA CCGTCCGAGGGCTCTGCACCAGGTACGAGCGACG AACCGTCGGAGGGTAGCGCTCCAGGTAGCCCAGC GGGCTCTCCGACAAGCACCGAAGAAGGCACCAGC ACCGAGCCGTCCGAAGGTTCCGCACCAGGTACAA GCGAGAGCGCGACTCCTGAATCTGGTCCGGGTAG CGAGCCTGCAACCAGCGGTTCTGAGACGCCGGGC ACTTCCGAATCTGCGACCCCGGAGTCCGGTCCAG GTTCAGAGCCGGCGACGAGCGGTTCGGAAACGCC GGGTACGTCTGAATCAGCCACGCCGGAGTCTGGT CCGGGTACCTCGACCGAACCAAGCGAAGGTTCGG CACCGGGTACTAGCGAGAGCGCAACCCCTGAAAG CGGTCCGGGCAGCCCGGCAGGTTCTCCAACCAGC ACCAAGAAGGTTCCCCTGCTGGTAGCCCGGACCT CTACGGAGGAAGGTAGCCCTGCAGGTTCCCCAAC TTCTACTGAGGAAGGTACTTCTGAGTCCGCTACC CCAGAAAGCGGTCCTGGTACCTCCACTGAACCGT CTGAAGGCTCTGCACCAGGCACTTCTGAGTCTGC TACTCCAGAAAGCGGCCCAGGTTCTGAACCAGCA ACTTCTGGCTCTGAGACTCCAGGCACTTCTGAGT CCGCAACGCCTGAATCCGGTCCTGGTTCTGAACC AGCTACTTCCGGCAGCGAAACCCCAGGTACCTCT GAGTCTGCGACTCCAGAGTCTGGTCCTGGTACTT CCACTGAGCCTAGCGAGGGTTCCGCACCAGGTTC TCCGGCTGGTAGCCCGACCAGCACGGAGGAGGGT ACGTCTGAATCTGCAACGCCGGAATCGGGCCCAG GTTCGGAGCCTGCAACGTCTGGCAGCGAAACCCC GGGTACCTCCGAATCTGCTACACCGGAAAGCGGT CCTGGCAGCCCTGCTGGTTCTCCAACCTCTACCG AGGAGGGTTCACCGGCAGGTAGCCCGACTAGCAC TGAAGAAGGTACTAGCACGGAGCCGAGCGAGGGT AGTGCTCCGGGTACGAGCGAGAGCGCAACGCCAG AGAGCGGTCCAGGCACCAGCGAATCGGCCACCCC TGAGAGCGGCCCAGGTACTTCTGAGAGCGCCACT CCTGAATCCGGCCCTGGTAGCGAGCCGGCAACCT CCGGCTCAGAAACTCCTGGTTCGGAACCAGCGAC CAGCGGTTCTGAAACTCCGGGTAGCCCGGCAGGC AGCCCAACGAGCACCGAAGAGGGTACCAGCACGG AACCGAGCGAGGGTTCTGCCCCGGGTACTTCCAC CGAACCATCGGAGGGCTCTGCACCTGGTAGCGAA | |

TABLE 7-continued

T-cell binding compositions

| Construct Name | Amino Acid Sequence | SEQ ID NO: | DNA Sequence | SEQ ID NO: |
|---|---|---|---|---|
| | | | CCTGCGACGTCTGGTTCTGAAACGCCGGGTACCA GCGAAAGCGCTACCCCAGAATCCGGTCCGGGCAC TAGCACCGAGCCATCGGAGGGCTCCGCACCAGGT CACCATCATCACCATCAC | |
| TBP-6 | ELVVTQEPSLTVS PGGTVTLTCRSST GAVTTSNYANWVQ QKPGQAPRGLIGG TNKRAPGTPARFS GSLLGGKAALTLS GVQPEDEAEYYCA LWYSNLWVFGGGT KLTVLGATPPETG AETESPGETTGGS AESEPPGEGEVQL LESGGGLVQPGGS LKLSCAASGFTFN TYAMNWVRQAPGK GLEWVARIRSKYN NYATYYADSVKDR FTISRDDSKNTAY LQMNNLKTEDTAV YYCVRHGNFGNSY VSWFAYWGQGTLV TVSSGTAEAASAS GLSGRSDNHVPLS LKMGPGSPAGSPT STEEGTSESATPE SGPGTSTEPSEGS APGSPAGSPTSTE EGTSTEPSEGSAP GTSTEPSEGSAPG TSESATPESGPGS EPATSGSETPGSE PATSGSETPGSPA GSPTSTEEGTSES ATPESGPGTSTEP SEGSAPGTSTEPS EGSAPGSPAGSPT STEEGTSTEPSEG SAPGTSTEPSEGS APGTSESATPESG PGTSTEPSEGSAP GTSESATPESGPG SEPATSGSETPGT STEPSEGSAPGTS TEPSEGSAPGTSE SATPESGPGTSES ATPESGPGSPAGS PTSTEEGTSESAT PESGPGSEPATSG SETPGTSESATPE SGPGTSTEPSEGS APGTSTEPSEGSA PGTSTEPSEGSAP GTSTEPSEGSAPG TSTEPSEGSAPGT STEPSEGSAPGSP AGSPTSTEEGTST EPSEGSAPGTSES ATPESGPGSEPAT SGSETPGTSESAT PESGPGSEPATSG SETPGTSESATPE SGPGTSTEPSEGS APGTSESATPESG PGSPAGSPTSTEE GSPAGSPTSTEEG SPAGSPTSTEEGT SESATPESGPGTS TEPSEGSAPGTSE SATPESGPGSEPA TSGSETPGTSESA | 435 | GAACTGGTCGTCACGCAGGAGCCGTCCCTTACCG TTTCACCAGGTGGAACAGTGACTCTGACGTGTCG CTCCTCCACTGGGGCGGTTACAACTTCCAATTAT GCTAATTGGGTCCAGCAGAAGCCGGGCCAAGCCC CTCGCGGGTTGATTGGCGGCACCAACAAACGTGC TCCAGGGACACCTGCCCGTTTTTCGGGCTCCTTA TTGGGGGGCAAAGCTGCACTGACGTTGTCTGGAG TTCAGCCGGAGGATGAGGCAGAGTATTACTGCGC ATTGTGGTATTCTAATTTATGGGTTTTTGGAGGC GGCACAAAGCTGACCGTCCTGggtgcgacccgc cggaaaccggtgcggaaaccgaaagcccgggtga aaccaccggtggcagcgcggagagcgaaccgccg ggtgaaggtGAGGTTCAGTTGTTGGAAAGCGGGG GCGGGCTTGTCCAACCTGGAGGTTCATTAAAATT GAGCTGTGCAGCCTCCGGATTCACCTTTAACACG TATGCAATGAACTGGGTCCGTCAAGCGCCCGGTA AGGGGCTGGAGTGGGTAGCTCGCATCCGCTCGAA GTATAATAATTACGCAACCTACTACGCAGACAGT GTCAAAGATCGCTTCACTATCTCACGCGACGACA GTAAGAACACGGCCTACTTACAGATGAACAATCT TAAAACGGAGGACACCGCTGTCTACTACTGCGTG CGCCACGGGAATTTCGGTAACTCTTATGTAAGTT GGTTCGCATATTGGGGACAAGGTACGTTGGTAAC CGTATCCAGCGGCACCGCCGAAGCAGCTagcgcc tctGGCctgTCAggtCGTtctGATaacCATgttC CActgTCTctgAAAatgGGTCCAGGTAGCCCAGC TGGTAGCCCAACCTCTACCGAAGAAGGTACCTCT GAATCCGCTACTCCAGAATCCGGTCCTGGTACTA GCACTGAGCCAAGCGAAGGTTCTGCTCCAGGCTC CCCCGGCAGGTAGCCCTACCTCTACCGAAGAGGG ACTAGCACCGAACCATCTGAGGGTTCCGCTCCTG GCACCTCCACTGAACCGTCCGAAGGCAGTGCTCC GGGTACTTCCGAAAGCGCAACTCCGGAATCCGGC CCTGGTTCTGAGCCTGCTACTTCCGGCTCTGAAA CTCCAGGTAGCGAGCCAGCGACTTCTGGTTCTGA AACTCCAGGTTCACCGGCGGGTAGCCCGACGAGC ACGGAGGAAGGTACCTCTGAGTCGGCCACTCCTG AGTCCGGTCCGGGCACGAGCACCGAGCCGAGCGA GGGTTCAGCCCCGGGTACCAGCACGGAGCCGTCC GAGGGTAGCGCACCGGGTTCTCCGGCGGGCTCCC CTACGTCTACGGAAGAGGGTACGTCCACTGAACC TAGCGAGGGCAGCGCGCCAGGCACCAGCACTGAA CCGAGCGAAGGCAGCGCACCTGGCACTAGCGAGT CTGCGACTCCGGAGAGCGGTCCGGGTACGAGCAC GGAACCAAGCGAAGGCAGCGCCCCAGGTACCTCT GAATCTGCTACCCCAGAATCTGGCCCGGGTTCCG AGCCAGCTACCTCTGGTTCTGAAACCCAGGTAG TTCCACTGAACCAAGCGAAGGTAGCGCTCCTGGC ACTTCTACTGAACCATCCGAAGGTTCCGCTCCTG GTACGTCTGAAAGCGCTACCCCTGAAAGCGGCCC AGGCACCTCTGAAAGCGCTACTCCTGAGAGCGGT CCAGGCTCTCCAGCAGGTTCTCCAACCTCCACTG AAGAAGGCACCTCTGAGTCTGCTACCCCTGAATC TGGTCCTGCTCCGAACCTGCTACCTCTGGTTCC GAAACTCCAGGTACCTCGGAATCTGCGACTCCGG AATCTGGCCCGGGCACGAGCACGGAGCCGTCTGA GGGTAGCGCACCAGGTACCAGCACTGAGCCTTCT GAGGGCTCTGCACCGGGTACCTCCACGGAACCTT CGGAAGGTTCTGCGCCGGGTACCTCCACTGAGCC ATCCGAGGGTTCAGCACCAGGTACTAGCGAGGAA CCGTCCGAGGGCTCTGCACCAGGTACGAGCACCG AACCGTCGGAGGGTAGCGCTCCAGGTAGCCCAGC GGGCTCTCCGACAAGCACCGAAGAAGGCACCAGC ACCAGCGTCCGAAGGTTCCGCACCAGGTACAA GCGAGAGCGCGACTCCTGAATCTGGTCCGGGTAG CGAGCCTGCCAACCAGCGGTTCTGAGACGCCGGGC ACTTCCGAATCTGCGACCCCGGAGTCCGGTCCAG GTTCAGAGCCGGCGACGAGCGGTTCGGAAACGCC GGGTACGTCTGAATCAGCCACGCCGGAGTCTGGT | 451 |

TABLE 7-continued

T-cell binding compositions

| Construct Name | Amino Acid Sequence | SEQ ID NO: | DNA Sequence | SEQ ID NO: |
|---|---|---|---|---|
| | TPESGPGSEPATS GSETPGTSESATP ESGPGTSTEPSEG SAPGSPAGSPTST EEGTSESATPESG PGSEPATSGSETP GTSESATPESGPG SPAGSPTSTEEGS PAGSPTSTEEGTS TEPSEGSAPGTSE SATPESGPGTSES ATPESGPGTSESA TPESGPGSEPATS GSETPGSEPATSG SETPGSPAGSPTS TEEGTSTEPSEGS APGTSTEPSEGSA PGSEPATSGSETP GTSESATPESGPG TSTEPSEGSAPGH HHHHH | | CCGGGTACCTCGACCGAACCAAGCGAAGGTTCGG CACCGGGTACTAGCGAGAGCGCAACCCCTGAAAG CGGTCCGGGCAGCCCGGCAGGTTCTCCAACCAGC ACCGAAGAAGGTTCCCCTGCTGGTAGCCCGACCT CTACGGAGGAAGGTAGCCCTGCAGGTTCCCCAAC TTCTACTGAGGAAGGTACTTCTGAGTCCGCTACC CCAGAAAGCGGTCCTGGTACCTCCACTGAACCGT CTGAAGGCTCTGCACCAGGCACTTCTGAGTCTGC TACTCCAGAAAGCGGCCCAGGTTCTGAACCAGCA ACTTCTGGCTCTGAGACTCCAGGCACTTCTGAGT CCGCAACGCCTGAATCCGGTCCTGGTTCTGAACC AGCTACTTCCGGCAGCGAAACCCCAGGTACCTCT GAGTCTGCGACTCCAGAGTCTGGTCCTGGTACTT CCACTGAGCCTAGCGAGGGTTCCGCACCAGGTTC TCCGGCTGGTAGCCCGACCAGCACGGAGGAGGT ACGTCTGAATCTGCAACGCCGGAATCGGGCCCAG GTTCGGAGCCTGCAACGTCTGGCAGCGAAACCCC GGGTACCTCCGAATCTGCTACACCGGAAAGCGGT CCTGGCAGCCCTGCTGGTTCTCAACCTCTACCG AGGAGGGTTCACCGGCAGGTAGCCCGACTAGCAC TGAAGAAGGTACTAGCACGGAGCCGAGCGAGGGT AGTGCTCCGGGTACGAGCGAGAGCGCAACGCCAG AGAGCGGTCCAGGCACCAGCGAATCGGCCACCCC TGAGAGCGGCCCAGGTACTTCTGAGAGCGCCACT CCTGAATCCGGCCCTGGTAGCGAGCCGGCAACCT CCGGCTCAGAAACTCCTGGTTCGGAACCAGCGAC CAGCGGTTCTGAAACTCCGGGTAGCCCGGCAGGC AGCCCAACGAGCACCGAAGAGGGTACCAGCACGG AACCGAGCGAGGGTTCTGCCCCGGGTACTTCCAC CGAACCATCGGAGGGCTCTGCACCTGGTAGCGAA CCTGCGACGTCTGGTTCTGAAACGCCGGGTACCA GCGAAAGCGCTACCCCAGAATCCGGTCCGGGCAC TAGCACCGAGCCATCGGAGGGCTCCGCACCAGGT CACCATCATCACCATCAC | |
| TBP-7 | EVQLLESGGGLVQ PGGSLKLSCAASG FTFNTYAMNWVRQ APGKGLEWVARIR SKYNNYATYYADS VKDRFTISRDDSK NTAYLQMNNLKTE DTAVYYCVRHGNF GNSYVSWFAYWGQ GTLVTVSSGATPP ETGAETESPGETT GGSAESEPPGEGE LVVTQEPSLTVSP GGTVTLTCRSSTG AVTTSNYANWVQQ KPGQAPRGLIGGT NKRAPGTPARFSG SLLGGKAALTLSG VQPEDEAEYYCAL WYSNLWVFGGGTK LTVLGTAEAASAS GLSGRSDNHSPLG LAGSPGSPAGSPT STEEGTSESATPE SGPGTSTEPSEGS APGSPAGSPTSTE EGTSTEPSEGSAP GTSTEPSEGSAPG TSESATPESGPGS EPATSGSETPGSE PATSGSETPGSPA GSPTSTEEGTSES ATPESGPGTSTEP SEGSAPGTSTEPS EGSAPGSPAGSPT STEEGTSTEPSEG SAPGSTEPSEGS APGTSESATPESG PGTSTEPSEGSAP | 436 | GAGGTTCAGTTGTTGGAAAGCGGGGCGGGCTTG TCCAACCTGGAGGTTCATTAAAATTGAGCTGTGC AGCCTCCGGATTCACCTTTAACACGTATGCAATG AACTGGGTCCGTCAAGCGCCCGGTAAGGGGCTGG AGTGGGTAGCTCGCATCCGCTCAGGTATAATAA TTACGCAACCTACTACGCAGACAGTGTCAAAGAT CGCTTCACTATCTCACGCGACGACAGTAAGAACA CGGCCTACTTACAGATGAACAATCTTAAAACGGA GGACACCGCTGTCTACTACTGCGTGCGCCACGGG AATTTCGGTAACTCTTATGTAAGTTGGTTCGCAT ATTGGGGACAAGGTACGTTGGTAACCGTATCCAG Cggtgcgaccccgccggaaaccggtgcggaaacc gaaagcccgggtgaaaccaccggtggcagcgcgg agagcgaaccgccgggtgaaggtGAACTGGTCGT CACGCAGGAGCCGTCCCTTACCGTTTCACCAGGT GGAACAGTGACTCTGACGTGTCGCTCCTCCACTG GGGCGGTTACAACTTCCAATTATGCTAATTGGGT CCAGCAGAAGCCGGGCCAAGCCCCTCGCGGGTTG ATTGGCGGCACCAACAAACGTGCTCCAGGGACAC CTGCCCGTTTTTCGGGCTCCTTATTGGGGGGCAA AGCTGCACTGACGTTGTCTGGAGTTCAGCCGGAG GATGAGGCAGAGTATTACTGCGCATTGTGGTATT CTAATTTATGGGTTTTTGGAGGCGGCACAAAGCT GACCGTCCTGGGCACCGCCGAAGCAGCTagcgcc tctGGCctgTCAggtCGTtctGATaacCATtccC CActgGGTctgGCTGGGTCTCCAGGTAGCCCAGG TGGTAGCCCAACCTCTACCGAAGAAGGTACCTCT GAATCCGCTACTCCAGAATCCGGTCCTGGTACTA GCACTGAGCCAAGCGAAGGTTCTGCTCCAGGCTC CCCGGCAGGTAGCTACCTCTACCGAAGAGGCT ACTAGCACCGAACCATCTGAGGGTTCCGCTCCTG GCACCTCCACTGAACCGTCCGAAGGCAGTGCTCC GGGTACTTCCGAAAGCGCAACTCCGGAATCCGGC CCTGGTTCTGAGCCTGCTACTTCCGGCTCTGAAA CTCCAGGTAGCGAGCCAGCGACTTCTGGTTCTGA AACTCCAGGTTCACCGGCGGGTAGCCCGACGAGC ACGGAGGAAGGTACCTCTGAGTCGGCCACTCCTG AGTCCGGTCCGGGCACGAGCACCGAGCCGAGCGA GGGTTCAGCCCCGGGTACCAGCACGGAGCCGTCC | 452 |

TABLE 7-continued

T-cell binding compositions

| Construct Name | Amino Acid Sequence | SEQ ID NO: | DNA Sequence | SEQ ID NO: |
|---|---|---|---|---|
| | GTSESATPESGPG SEPATSGSETPGT STEPSEGSAPGTS TEPSEGSAPGTSE SATPESGPGTSES ATPESGPGSPAGS PTSTEEGTSESAT PESGPGSEPATSG SETPGTSESATPE SGPGTSTEPSEGS APGTSTEPSEGSA PGTSTEPSEGSAP GTSTEPSEGSAPG TSTEPSEGSAPGT STEPSEGSAPGSP AGSPTSTEEGTST EPSEGSAPGTSES ATPESGPGSEPAT SGSETPGTSESAT PESGPGSEPATSG SETPGTSESATPE SGPGTSTEPSEGS APGTSESATPESG PGSPAGSPTSTEE GSPAGSPTSTEEG SPAGSPTSTEEGT SESATPESGPGTS TEPSEGSAPGTSE SATPESGPGSEPA TSGSETPGTSESA TPESGPGSEPATS GSETPGTSESATP ESGPGTSTEPSEG SAPGSPAGSPTST EEGTSESATPESG PGSEPATSGSETP GTSESATPESGPG SPAGSPTSTEEGS PAGSPTSTEEGTS TEPSEGSAPGTSE SATPESGPGTSES ATPESGPGTSESA TPESGPGSEPATS GSETPGSEPATSG SETPGSPAGSPTS TEEGTSTEPSEGS APGTSTEPSEGSA PGSEPATSGSETP GTSESATPESGPG TSTEPSEGSAPGH HHHHH | | GAGGGTAGCGCACCGGGTTCTCCGGCGGGCTCCC CTACGTCTACGGAAGAGGGTACGTCCACTGAACC TAGCGAGGGCAGCGCGCCAGGCACCAGCACTGAA CCGAGCGAAGGCAGCGCACCTGGCACTAGCGAGT CTGCGACTCCGGAGAGCGGTCCGGGTACGAGCAC GGAACCAAGCGAAGGCAGCGCCCCAGGTACCTCT GAATCTGCTACCCCAGAATCTGGCCCGGGTTCCG AGCCAGCTACCTCTGGTTCTGAAACCCCAGGTAC TTCCACTGAACCAAGCGAAGGTAGCGCTCCTGGC ACTTCTACTGAACCATCCGAAGGTTCCGCTCCTG GTACGTCTGAAAGCGCTACCCCTGAAAGCGGCT AGGCACCTCTGAAAGCGCTACTCCTGAGAGCGGT CCAGGCTCTCCAGCAGGTTCTCCAACCTCCACTG AAGAAGGCACCTCTGAGTCTGCTACCCCTGAATC TGGTCCTGGCTCCGAACCTGCTACCTCTGGTTCC GAAACTCCAGGTACCTCGGAATCTGCAGACTCCGG AATCTGGCCCGGGCACGAGCACGGAGCCGTCTGA GGGTAGCGCACCAGGTACCAGCACTGAGCCTTCT GAGGGCTCTGCACCGGGTACCTCCACGGAACCTT CGGAAGGTTCTGCGCCGGGTACCTCCACTGAGCC ATCCGAGGGTTCAGCACCAGGTACTAGCACGGAA CCGTCCGAGGGCTCTGCACCAGGTACGAGCACCG AACCGTCGGAGGGTAGCGCTCCAGGTAGCCGAGC GGGCTCTCCGACAAGCACCGAAGAAGGCACCAGC ACCGAGCCGTCCGAAGGTTCCGCACCAGGTACAA GCGAGAGCGCGACTCCTGAATCTGGTCCGGGTAG CGAGCCTGCAACCAGCGGTTCTGAGACGCCGGGC ACTTCCGAATCTGCGACCCCGGAGTCCGGTCCAG GTTCAGAGCCGGCGACGAGCGGTTCGGAAACGCC GGGTACGTCTGAATCAGCCACGCCGGAGTCTGGT CCGGGTACCTCGACCGAACCAAGCGAAGGTTCGG CACCGGGTACTAGCGAGAGCGCAACCCCTGAAAG CGGTCCGGGCAGCCCGGCAGGTTCTCCAACCAGC ACCGAAGAAGGTTCCCCTGCTGGTAGCCCGACCT CTACGGAGGAAGGTAGCCCTGCAGGTTCCCAAC TTCTACTGAGGAAGGTACTTCTGAGTCCGTACC CCAGAAAGCGGTCCTGGTACCTCCACTGAACCGT CTGAAGGCTCTGCACCAGGCACTTCTGAGTCTGC TACTCCAGAAAGCGGCCCAGGTTCTGAACCAGCA ACTTCTGGCTCTGAGACTCCAGGCACTTCTGAGT CCGCAACGCCTGAATCCGGTCCTGGTTCTGAACC AGCTACTTCCGGCAGCGAAACCCCAGGTACCTCT GAGTCTGCGACTCCAGAGTCTGGTCCTGGTACTT CCACTGAGCCTAGCGAGGGTTCCGCACCAGGTTC TCCGGCTGGTAGCCCGACCAGCACGGAGGAGGGT ACGTCTGAATCTGCAACGCCGGAATCGGGCCCAG GTTCGGAGCCTGCAACGTCTGGCAGCGAAACCCC GGGTACCTCCGAATCTGCTACACCGGAAAGCGGT CCTGGCAGCCCTGCTGGTTCTCCAACCTCTACCG AGGAGGGTTCACCGGCAGGTAGCCCGACTAGCAC TGAAGAAGGTACTAGCACGGAGCCGAGCGAGGGT AGTGCTCCGGGTACGAGCGAGAGCGCAACGCCAG AGAGCGGTCCAGGCACCAGCGAATCGGCCACCCC TGAGAGCGGCCCAGGTACTTCTGAGAGCGCACT CCTGAATCCGGCCCTGGTAGCGAGCCGGCAACCT CCGGCTCAGAAACTCCTGGTTCGGAACCAGCGAC CAGCGGTTCTGAAACTCCGGGTAGCCCGGCAGGC AGCCCAACGAGCACCGAAGAGGGTACCAGCACGG AACCGAGCGAGGGTTCTGCCCCGGGTACTTCCAC CGAACCATCGGAGGGCTCTGCACCTGGTAGCGAA CCTGCGACGTCTGGTTCTGAAACGCCGGGTACCA GCGAAAGCGCTACCCCAGAATCGGTCCGGGCAC TAGCACCGAGCCATCGGAGGGCTCCGCACCAGGT CACCATCATCACCATCAC | |
| TBP-8 | EVQLLESGGGLVQ PGGSLKLSCAASG FTFNTYAMNWVRQ APGKGLEWVARIR SKYNNYATYYADS VKDRFTISRDDSK NTAYLQMNNLKTE DTAVYYCVRHGNF GNSYVSWFAYWGQ | 437 | GAGGTTCAGTTGTTGGAAAGCGGGGCGGGCTTG TCCAACCTGGAGGTTCATTAAAATTGAGCTGTGC AGCCTCCGGATTCACCTTTAACACGTATGCAATG AACTGGGTCCGTCAAGCGCCCGGTAAGGGGCTGG AGTGGGTAGCTCGCATCCGCTCGAAGTATAATAA TTACGCAACCTACTACGCAGACAGTGTCAAAGAT CGCTTCACTATCTCACGCGACGACAGTAAGAACA CGGCCTACTTACAGATGAACAATCTTAAAACGGA GGACACCGCTGTCTACTACTGCGTGCGCCACGGG | 453 |

TABLE 7-continued

T-cell binding compositions

| Construct Name | Amino Acid Sequence | SEQ ID NO: | DNA Sequence | SEQ ID NO: |
|---|---|---|---|---|
| | GTLVTVSSGATPP | | AATTTCGGTAACTCTTATGTAAGTTGGTTCGCAT | |
| | ETGAETESPGETT | | ATTGGGGACAAGGTACGTTGGTAACCGTATCCAG | |
| | GGSAESEPPGEGE | | Cggtgcgaccccgccggaaaccggtgcggaaacc | |
| | LVVTQEPSLTVSP | | gaaagcccggtgaaaccaccggtggcagcgcgg | |
| | GGTVTLTCRSSTG | | agagcgaaccgccgggtgaaggtGAACTGGTCGT | |
| | AVTTSNYANWVQQ | | CACGCAGGAGCCGTCCCTTACCGTTTCACCAGGT | |
| | KPGQAPRGLIGGT | | GGAACAGTGACTCTGACGTGTCGCTCCTCCACTG | |
| | NKRAPGTPARFSG | | GGGCGGTTACAACTTCCAATTATGCTAATTGGGT | |
| | SLLGGKAALTLSG | | CCAGCAGAAGCCGGGCCAAGCCCCTCGCGGGTTG | |
| | VQPEDEAEYYCAL | | ATTGGCGGCACCAACAAACGTGCTCCAGGGACAC | |
| | WYSNLWVFGGGTK | | CTGCCCGTTTTTCGGGCTCCTTATTGGGGGCAA | |
| | LTVLGTAEAASAS | | AGCTGCACTGACGTTGTCTGGAGTTCAGCCGGAG | |
| | GLSGRSDNHVPLS | | GATGAGGCAGAGTATTACTGCGCATTGTGGTATT | |
| | LKMGPGSPAGSPT | | CTAATTTATGGGTTTTTGGAGGCGGCACAAAGCT | |
| | STEEGTSESATPE | | GACCGTCCTGGGCACCGCCGAAGCAGCTagcgcc | |
| | SGPGTSTEPSEGS | | tctGGCctgTCAggtCGTtctGATaacCATgttC | |
| | APGSPAGSPTSTE | | CActgTCTctgAAAatgGGTCCAGGTAGCCCAGC | |
| | EGTSTEPSEGSAP | | TGGTAGCCCAACCTCTACCGAAGAAGGTACCTCT | |
| | GTSTEPSEGSAPG | | GAATCCGCTACTCCAGAATCCGGTCCTGGTACTA | |
| | TSESATPESGPGS | | GCACTGAGCCAAGCGAAGGTTCTGCTCCAGGCTC | |
| | EPATSGSETPGSE | | CCCGGCAGGTAGCCCTACCTCTACCGAAGAGGGC | |
| | PATSGSETPGSPA | | ACTAGCACCGAACCATCTGAGGGTTCCGCTCCTG | |
| | GSPTSTEEGTSES | | GCACCTCCACTGAACCGTCCGAAGGCAGTGCTCC | |
| | ATPESGPGTSTEP | | GGGTACTTCCGAAAGCGCAACTCCGGAATCCGGC | |
| | SEGSAPGTSTEPS | | CCTGGTTCTGAGCCTGCTACTTCCGGCTCTGAAA | |
| | EGSAPGSPAGSPT | | CTCCAGGTAGCGAGCCAGCGACTTCTGGTTCTGA | |
| | STEEGTSTEPSEG | | AACTCCAGGTTCACCGGCGGGTAGCCCGACGAGC | |
| | SAPGTSTEPSEGS | | ACGGAGGAAGGTACCTCTGAGTCGGCCACTCCTG | |
| | APGTSESATPESG | | AGTCCGGTCCGGGCACGAGCACCGAGCCGAGCGA | |
| | PGTSTEPSEGSAP | | GGGTTCAGCCCCGGGTACCAGCACGGAGCCGTCC | |
| | GTSESATPESGPG | | GAGGGTAGCGCACCGGGTTCTTCCGGCGGGCTCCC | |
| | SEPATSGSETPGT | | CTACGTCTACGGAAGAGGGTACGTCCACTGAACC | |
| | STEPSEGSAPGTS | | TAGCGAGGGCAGCGCGCCAGGCACCAGCACTGAA | |
| | TEPSEGSAPGTSE | | CCGAGCGAAGGCAGCGCACCTGGCACTAGCGAGT | |
| | SATPESGPGTSES | | CTGCGACTCCGGAGAGCGGTCCGGGTACGAGCAC | |
| | ATPESGPGSPAGS | | GGAACCAAGCGAAGGCAGCGCCCCAGGTACCTCT | |
| | PTSTEEGTSESAT | | GAATCTGCTACCCCAGAATCTGGCCCGGGTTCCG | |
| | PESGPGSEPATSG | | AGCCAGCTACCTCTGGTTCTGAAACCCCAGGTAC | |
| | SETPGTSESATPE | | TTCCACTGAACCAAGCGAAGGTAGCGCTCCTGGC | |
| | SGPGTSTEPSEGS | | ACTTCTACTGAACCATCCGAAGGTTCCGCTCCTG | |
| | APGTSTEPSEGSA | | GTACGTCTGAAAGCGCTACCCCTGAAAGCGGCCC | |
| | PGTSTEPSEGSAP | | AGGCACCTCTGAAAGCGCTACCTCTGAGAGCGGT | |
| | GTSTEPSEGSAPG | | CCAGGCTCTCCAGCAGGTTCTCCAACCTCCACTG | |
| | TSTEPSEGSAPGT | | AAGAAGGCACCTCTGAGTCTGCTACCCCTGAATC | |
| | STEPSEGSAPGSP | | TGGTCCTGGCTCCGAACCTGCTACCTCTGGTTCC | |
| | AGSPTSTEEGTST | | GAAACTCCAGGTACCTCGGAATCTGCGACTCCGG | |
| | EPSEGSAPGTSES | | AATCTGGCCCGGGCACGAGCACGGAGCCGTCTGA | |
| | ATPESGPGSEPAT | | GGGTAGCGCACCAGGTACCAGCACTGAGCCTTCT | |
| | SGSETPGTSESAT | | GAGGGCTCTGCACCGGGTACCTCCACGGAACCTT | |
| | PESGPGSEPATSG | | CGGAAGGTTCTGCGCCGGGTACCTCCACTGAGCC | |
| | SETPGTSESATPE | | ATCCGAGGGTTCAGCACCAGGTACTAGCACGGAA | |
| | SGPGTSTEPSEGS | | CCGTCCGAGGGCTCTGCACCAGGTACGAGCACCG | |
| | APGTSESATPESG | | AACCGTCGGAGGGTAGCGCTCCAGGTAGCCCAGC | |
| | PGSPAGSPTSTEE | | GGGCTCTCCGACAAGCACCGAAGAAGGCACCAGC | |
| | GSPAGSPTSTEEG | | ACCGAGCCGTCCGAAGGTTCCGCACCAGGTACAA | |
| | SPAGSPTSTEEGT | | GCGAGAGCGCGACTCCTGAATCTGGTCCGGGTAG | |
| | SESATPESGPGTS | | CGAGCCTGCAACCAGCGGTTCTGAGACGCCGGGC | |
| | TEPSEGSAPGTSE | | ACTTCCGAATCTGCGACCCCGGAGTCCGGTCCAG | |
| | SATPESGPGSEPA | | GTTCAGACCGGCGACGAGCGGTTCGGAAACGCC | |
| | TSGSETPGTSESA | | GGGTACGTCTGAATCAGCCACGCCGGAGTCTGGT | |
| | TPESGPGSEPATS | | CCGGGTACCTCGACCGAACCAAGCGAAGGTTCCG | |
| | GSETPGTSESATP | | CACCGGGTACTAGCGAGAGCGCAACCCCTGAAAG | |
| | ESGPGTSTEPSEG | | CGGTCCGGGCAGCCCGGCAGGTTCTCCAACCAGC | |
| | SAPGSPAGSPTST | | ACCGAAGAAGGTTCCCCTGCTGGTAGCCCGACCT | |
| | EEGTSESATPESG | | CTACGGAGGAAGGTAGCCCTGCAGGTTCCATCGA | |
| | PGSEPATSGSETP | | TTCTACTGAGGAAGGTACTTCTGAGTCCGCTACC | |
| | GTSESATPESGPG | | CCAGAAAGCGGTCCTGGTACCTCCACTGAACCGT | |
| | SPAGSPTSTEEGS | | CTGAAGGCTCTGCACCAGGCACTTCTGAGTCTGC | |
| | PAGSPTSTEEGTS | | TACTCCAGAAAGCGGCCAGGTTCTGAACCAGCA | |
| | TEPSEGSAPGTSE | | ACTTCTGGCTCTGAGACTCCAGGCACTTCTGAGT | |
| | SATPESGPGTSES | | CCGCAACGCCTGAATCCGGTCCTGGTTCTGAACC | |
| | ATPESGPGTSESA | | AGCTACTTCCGGCAGCGAAACCCCAGGTACCTCT | |
| | TPESGPGSEPATS | | GAGTCTGCGACTCCAGAGTCTGGTCCTGGTACTT | |
| | GSETPGSEPATSG | | CCACTGAGCCTAGCGAGGGTTCCGCACCAGGTTC |

TABLE 7-continued

T-cell binding compositions

| Construct Name | Amino Acid Sequence | SEQ ID NO: | DNA Sequence | SEQ ID NO: |
|---|---|---|---|---|
| | SETPGSPAGSPTS TEEGTSTEPSEGS APGTSTEPSEGSA PGSEPATSGSETP GTSESATPESGPG TSTEPSEGSAPGH HHHHH | | TCCGGCTGGTAGCCCGACCAGCACGGAGGAGGGT ACGTCTGAATCTGCAACGCCGGAATCGGGCCCAG GTTCGGAGCCTGCAACGTCTGGCAGCGAAACCCC GGGTACCTCCGAATCTGCTACACCGGAAAGCGGT CCTGGCAGCCCTGCTGGTTCTCCAACCTCTACCG AGGAGGGTTCACCGGCAGGTAGCCCGACTAGCAC TGAAGAAGGTACTAGCACGGAGCCGAGCGAGGGT AGTGCTCCGGGTACGAGCGAGAGCGCAACGCCAG AGAGCGGTCCAGGCACCAGCGAATCGGCCACCCC TGAGAGCGGCCCAGGTACTTCTGAGAGCGCCACT CCTGAATCCGGCCCTGGTAGCGAGCCGGCAACCT CCGGCTCAGAAACTCCTGGTTCGGAACCAGCGAC CAGCGGTTCTGAAACTCCGGGTAGCCCGGCAGGC AGCCCAACGAGCACCGAAGAGGGTACCAGCACGG AACCGAGCGAGGGTTCTGCCCCGGGTACTTCCAC CGAACCATCGGAGGGCTCTGCACCTGGTAGCGAA CCTGCGACGTCTGGTTCTGAAACGCCGGGTACCA GCGAAAGCGCTACCCCAGAATCCGGTCCGGGCAC TAGCACCGAGCCATCGGAGGGCTCCGCACCAGGT CACCATCATCACCATCAC | |
| TBP-9 | HHHHHHGGSPAGS PTSTEEGTSESAT PESGPGTSTEPSE GSAPGSPAGSPTS TEEGTSTEPSEGS APGTSTEPSEGSA PGTSESATPESGP GSEPATSGSETPG SEPATSGSETPGS PAGSPTSTEEGTS ESATPESGPGTST EPSEGSAPGTSTE PSEGSAPGSPAGS PTSTEEGTSTEPS EGSAPGTSTEPSE GSAPGTSESATPE SGPGTSTEPSEGS APGTSESATPESG PGSEPATSGSETP GTSTEPSEGSAPG TSTEPSEGSAPGT SESATPESGPGTS ESATPESGPGSPA GSPTSTEEGTSES ATPESGPGSEPAT SGSETPGTSESAT PESGPGTSTEPSE GSAPGTSTEPSEG SAPGTSTEPSEGS APGTSTEPSEGSA PGTSTEPSEGSAP GTSTEPSEGSAPG SPAGSPTSTEEGT STEPSEGSAPGTS ESATPESGPGSEP ATSGSETPGTSES ATPESGPGSEPAT SGSETPGTSESAT PESGPGTSTEPSE GSAPGTSESATPE SGPGSPAGSPTST EEGSPAGSPTSTE EGSPAGSPTSTEE GTSESATPESGPG TSTEPSEGSAPGT SESATPESGPGSE PATSGSETPGTSE SATPESGPGSEPA TSGSETPGTSESA TPESGPGTSTEPS EGSAPGSPAGSPT STEEGTSESATPE SGPGSEPATSGSE | 438 | CATCACCACCATCATCACggAGGTAGCCCAGCTG GTAGCCCAACCTCTACCGAAGAAGGTACCTCTGA ATCCGCTACTCCAGAATCCGGTCCTGGTACTAGC ACTGAGCCAAGCGAAGGTTCTGCTCCAGGCTCCC CGGCAGGTAGCCCTACCTCTACCGAAGAGGGCAC TAGCACCGAACCATCTGAGGGTTCCGCTCCTGGC ACCTCCACTGAACCGTCCGAAGGCAGTGCTCCGG GTACTTCCGAAAGCGCAACTCCGGAATCCGGCCC TGGTTCTGAGCCTGCTACTTCCGGCTCTGAAACT CCAGGTAGCGAGCCAGCGACTTCTGGTTCTGAAA CTCCAGGTTCACCGGCGGGTAGCCCGACGAGCAC GGAGGAAGGTACCTCTGAGTCGGCCACTCCTGAG TCCGGTCCGGGCACGAGCACCGAGCCGAGCGAGG GTTCAGCCCCGGGTACCAGCACGGAGCCGTCCGA GGGTAGCGCACCGGGTTCTCCGGCGAGCTCCCT ACGTCTACGGAAGAGGGTACGTCCACTGAACCTA GCGAGGGCAGCGCGCCAGGCACCAGCACTGAACC GAGCGAAGGCAGCGCACCTGGCACTAGCGAGTCT GCGACTCCGGAGAGCGGTCCGGGTACGAGCACGG AACCAAGCGAAGGCAGCGCCCCAGGTACCTCTGA ATCTGCTACCCCAGAATCTGGCCCGGGTTCCGAG CCAGCTACCTCTGGTTCTGAAACCCCAGGTACTT CCACTGAACCAAGCGAAGGTAGCTCCTGGCACG GSPTSTEEGTSES TTCTACTGAACCATCCGAAGGTTCCGCTCCTGGT ACGTCTGAAAGCGCTACCCCTGAAAGCGGCCCAG GCACCTCTGAAAGCGCTACTCCTGAGAGCGGTCC AGGCTCTCCAGCAGGTTCTCCAACCTCCACTGAA GAAGGCACCTCTGAGTCTGCTACCCCTGAATCTG GTCCTGGCTCCGAACCTGCTACCTCTGGTTCCGA AACTCCAGGTACCTCGGAATCTGCGACTCCGGAA TCTGGCCCGGGCACGAGCACGGAGCCGTCTGAGG GTAGCGCACCAGGTACCAGCACTGAGCCTTCTGA GGGCTCTGCACCGGGTACCTCCACGGAACCTTCG GAAGGTTCTGCGCCGGGTACCTCCACTGAGCCAT CCGAGGGTTCAGCACCAGGTACTAGCACGGAACC GTCCGAGGGCTCTGCACCAGGTACGAGCACCGAA CCGTCGGAGGGTAGCGCTCCAGGTAGCACCAGCGG GCTCTCCGACAAGCACCGAAGAGGCACCAGCAC CGAGCCGTCCGAAGGTTCCGCACCAGGTACAAGC GAGAGCGCGACTCCTGAATCTGGTCCGGGTAGCG AGCCTGCAACCAGCGGTTCTGAGACGCCGGGCAC TTCCGAATCTGCGACCCCGGAGTCCGGTCCAGGT TCAGAGCCGGCGACGAGCGGTTCGGAAACGCCGG GTACGTCTGAATCAGCCACGCCGAGTCTGGTCC GGGTACCTCGACCGAACCAAGCGAAGGTTCGGCA CCGGGTACTAGCGAGAGCGCAACCCCTGAAAGCG GTCCGGGCAGCCCGGCAGGTTCTCCAACCAGCAC CGAAGAAGGTTCCCCTGCTGGTAGCCCGGACCCT ACGGAGGAAGGTAGCCCTGCAGGTTCCCCAACTT CTACTGAAGAAGGTACTTCTGAGTCCGCTACCCC AGAAAGCGGTCCTGGTACCTCCACTGAACCGTCT GAAGGCTCTGCACCAGGCACTTCTGAGTCTGCTA CTCCAGAAAGCGGCCCAGGTTCTGAACCAGCAAC | 454 |

TABLE 7-continued

T-cell binding compositions

| Construct Name | Amino Acid Sequence | SEQ ID NO: | DNA Sequence | SEQ ID NO: |
|---|---|---|---|---|
| | TPGTSESATPESG | | TTCTGGCTCTGAGACTCCAGGCACTTCTGAGTCC | |
| | PGSPAGSPTSTEE | | GCAACGCCTGAATCCGGTCCTGGTTCTGAACCAG | |
| | GSPAGSPTSTEEG | | CTACTTCCGGCAGCGAAACCCCAGGTACCTCTGA | |
| | TSTEPSEGSAPGT | | GTCTGCGACTCCAGAGTCTGGTCCTGGTACTTCC | |
| | SESATPESGPGTS | | ACTGAGCCTAGCGAGGGTTCCGCACCAGGTTCTC | |
| | ESATPESGPGTSE | | CGGCTGGTAGCCCGACCAGCACGGAGGAGGTAC | |
| | SATPESGPGSEPA | | GTCTGAATCTGCAACGCCGGAATCGGGCCCAGGT | |
| | TSGSETPGSEPAT | | TCGGAGCCTGCAACGTCTGGCAGCGAAACCCCGG | |
| | SGSETPGSPAGSP | | GTACCTCCGAATCTGCTACACCGGAAAGCGGTCC | |
| | TSTEEGTSTEPSE | | TGGCAGCCCTGCTGGTTCTCCAACCTCTACCGAG | |
| | GSAPGTSTEPSEG | | GAGGGTTCACCGGCAGGTAGCCCGACTAGCACTG | |
| | SAPGSEPATSGSE | | AAGAAGGTACTAGCACGGAGCCGAGCGAGGGTAG | |
| | TPGTSESATPESG | | TGCTCCGGGTACGAGCGAGAGCGCAACGCCAGAG | |
| | PGTSTEPSEGSAP | | AGCGGTCCAGGCACCAGCGAATCGGCCACCCCTG | |
| | LSGRSDNHSPLGL | | AGAGCGGCCCAGGTACTTCTGAGAGCGCCACTCA | |
| | AGSGTAEAASASG | | TGAATCCGGCCCTGGTAGCGAGCCGGCAACCTCC | |
| | DIQMTQSPSSLSA | | GGCTCAGAAACTCCTGGTTCGGAACCAGCGACCA | |
| | SVGDRVTITCRAS | | GCGGTTCTGAAACTCCGGGTAGCCCGGCAGGCAG | |
| | QDIRNYLNWYQQK | | CCCAACGAGCACCGAAGAGGGTACCAGCACGGAA | |
| | PGKAPKLLIYYTS | | CCGAGCGAGGGTTCTGCCCCGGGTACTTCCACCG | |
| | RLESGVPSRFSGS | | AACCATCGGAGGGCTCTGCACCTGGTAGCGAACC | |
| | GSGTDYTLTISSL | | TGCGACGTCTGGTTCTGAAACGCCGGGTACCAGC | |
| | QPEDFATYYCQQG | | GAAAGCGCTACCCCAGAATCCGGTCCGGACTA | |
| | NTLPWTFGQGTKV | | GCACCGAGCCATCGGAGGGCTCCGCACCActgTC | |
| | EIKGATPPETGAE | | AggtCGTtctGATaacCATtccCCActgGGTctg | |
| | TESPGETTGGSAE | | GCTGGGTCTGGCACCGCCGAAGCAGCTagcgcct | |
| | SEPPGEGEVQLVE | | ctGGCGACATCCAAATGACCCAATCACCGTCGT | |
| | SGGGLVQPGGSLR | | CCTGAGCGCCTCTGTTGGAGATCGTGTAACAATT | |
| | LSCAASGYSFTGY | | ACCTGCCGCGCCTCCCAAGACATCCGCAATTACT | |
| | TMNWVRQAPGKGL | | TAAACTGGTATCAGCAAAAACCCGGTAAGGCACC | |
| | EWVALINPYKGVS | | GAAATTGCTGATTTATTATACTTCACGCTTAGAG | |
| | TYNQKFKDRFTIS | | AGTGGGGTGCCGTCGCGCTTCAGTGGGTCGGGTA | |
| | VDKSKNTAYLQMN | | GTGGGACCGATTACACATTGACAATTTCATCACT | |
| | SLRAEDTAVYYCA | | GCAGCCAGAGGATTTTGCGACTTATTACTGTCAA | |
| | RSGYYGDSDWYFD | | CAGGGTAACACGCTTCCCTGGACCTTCGGGCAAG | |
| | VWGQGTLVTVSS | | GCACGAAAGTTGAGATCAAGGGCGCTACTCCCCC | |
| | | | TGAGACAGGAGCGGAAACGGAATCCCCTGGCGAG | |
| | | | ACGACGGGTGGTTCCGCAGAGTCGGAACCTCCTG | |
| | | | GTGAGGGCGAGGTGCAGCTGGTTGAAAGCGGTGG | |
| | | | CGGTCTGGTGCAACCAGGCGGTAGCCTGCGTCTG | |
| | | | AGCTGCGCGGCGAGCGGTTACAGCTTTACCGGTT | |
| | | | ATACCATGAACTGGGTTCGTCAAGCGCCAGGTAA | |
| | | | AGGTCTGGAGTGGGTGGCGCTGATCAACCCGTAC | |
| | | | AAGGGTGTTAGCACCTATAACCAGAAGTTCAAAG | |
| | | | ACCGTTTTACCATTAGCGTGGATAAGAGCAAAAA | |
| | | | CACCGCGTACCTGCAAATGAACAGCCTGCGTGCG | |
| | | | GAGGACACCGCTGTGTACTATTGCGCGCGTAGCG | |
| | | | GTTACTATGGCGACAGCGACTGGTATTTTGATGT | |
| | | | GTGGGGCCAAGGCACCCTGGTTACCGTGAGCTCC | |
| TBP-10 | HHHHHHGGSPAGS | 439 | CATCACCACCATCATCACggAGGTAGCCCAGCTG | 455 |
| | PTSTEEGTSESAT | | GTAGCCCAACCTCTACCGAAGAAGGTACCTCTGA | |
| | PESGPGTSTEPSE | | ATCCGCTACTCCAGAATCCGGTCCTGGTACTAGC | |
| | GSAPGSPAGSPTS | | ACTGAGCCAAGCGAAGGTTCTGCTCCAGGCTCCC | |
| | TEEGTSTEPSEGS | | CGGCAGGTAGCCCTACCTCTACCGAAGAGGGCAC | |
| | APGTSTEPSEGSA | | TAGCACCGAACCATCTGAGGGTTCCGCTCCTGGC | |
| | PGTSESATPESGP | | ACCTCCACTGAACCGTCCGAAGGCAGTGCTCCGG | |
| | GSEPATSGSETPG | | GTACTTCCGAAAGCGCAACTCCGGAATCCGGCCC | |
| | SEPATSGSETPGS | | TGGTTCTGAGCCTGCTACTTCCGGCTCTGAAACT | |
| | PAGSPTSTEEGTS | | CCAGGTAGCGAGCCAGCGACTTCTGGTTCTGAAA | |
| | ESATPESGPGTST | | CTCCAGGTTCACCGGCGGGTAGCCCGACGGCTCA | |
| | EPSEGSAPGTSTE | | GGAGGAAGGTACCTCTGAGTCGGCCACTCCTGAG | |
| | PSEGSAPGSPAGS | | TCCGGTCCGGGCACGAGCACCGAGCCGAGCGAGG | |
| | PTSTEEGTSTEPS | | GTTCAGCCCCGGGTACCAGCACGGAGCCGTCCGA | |
| | EGSAPGTSTEPSE | | GGGTAGCGCACCGGGTTCTCCGGCGGGCTCCCCT | |
| | GSAPGTSESATPE | | ACGTCTACGGAAGAGGGTACGTCCACTGAACCTA | |
| | SGPGTSTEPSEGS | | GCGAGGGCAGCGCGCCAGGCACCAGCACTGAACC | |
| | APGTSESATPESG | | GAGCGAAGGCAGCGCACCTGGCACTAGCGAGTCT | |
| | PGSEPATSGSETP | | GCGACTCGGAGAGCGGTCCGGGTACGACCACG | |
| | GTSTEPSEGSAPG | | AACCAAGCGAAGGCAGCGCCCCAGGTACCTCTGA | |
| | TSTEPSEGSAPGT | | ATCTGCTACCCCAGAATCTGGCCCGGGTTCCGAG | |
| | SESATPESGPGTS | | CCAGCTACCTCTGGTTCTGAAACCCCAGGTACTT | |
| | ESATPESGPGSPA | | CCACTGAACCAAGCGAAGGTAGCGCTCCTGGCAC | |
| | GSPTSTEEGTSES | | TTCTACTGAACCATCCGAAGGTTCCGCTCCTGGT | |

TABLE 7-continued

T-cell binding compositions

| Construct Name | Amino Acid Sequence | SEQ ID NO: | DNA Sequence | SEQ ID NO: |
|---|---|---|---|---|
| | ATPESGPGSEPAT | | ACGTCTGAAAGCGCTACCCCTGAAAGCGGCCCAG | |
| | SGSETPGTSESAT | | GCACCTCTGAAAGCGCTACTCCTGAGAGCGGTG | |
| | PESGPGTSTEPSE | | AGGCTCTCCAGCAGGTTCTCCAACCTCCACTGAA | |
| | GSAPGTSTEPSEG | | GAAGGCACCTCTGAGTCTGCTACCCCTGAATCTG | |
| | SAPGTSTEPSEGS | | GTCCTGGCTCCGAACCTGCTACCTCTGGTTCCGA | |
| | APGTSTEPSEGSA | | AACTCCAGGTACCTCGGAATCTGCGACTCCGGAA | |
| | PGTSTEPSEGSAP | | TCTGGCCCGGGCACGAGCACGGAGCCGTCTGAGG | |
| | GTSTEPSEGSAPG | | GTAGCGCACCAGGTACCAGCACTGAGCCTTCTGA | |
| | SPAGSPTSTEEGT | | GGGCTCTGCACCGGGTACCTCCACGGAACCTTCG | |
| | STEPSEGSAPGTS | | GAAGGTTCTGCGCCGGGTACCTCCACTGAGCCAT | |
| | ESATPESGPGSEP | | CCGAGGGTTCAGCACCAGGTACTAGCACGGAACC | |
| | ATSGSETPGTSES | | GTCCGAGGGCTCTGCACCAGGTACGAGCACCGAA | |
| | ATPESGPGSEPAT | | CCGTCGGAGGGTAGCGCTCCAGGTAGCCCAGCGG | |
| | SGSETPGTSESAT | | GCTCTCCGACAAGCACCGAAGAAGGCACCAGCAC | |
| | PESGPGTSTEPSE | | CGAGCCGTCCGAAGGTTCCGCACCAGGTACAAGC | |
| | GSAPGTSESATPE | | GAGAGCGCGACTCCTGAATCTGGTCCGGGTAGCG | |
| | SGPGSPAGSPTST | | AGCCTGCAACCAGCGGTTCTGAGACGCCGGGCAC | |
| | EEGSPAGSPTSTE | | TTCCGAATCTGCGACCCCGGAGTCCGGTCCAGGT | |
| | EGSPAGSPTSTEE | | TCAGAGCCGGCGACGAGCGGTTCGGAAACGCCGG | |
| | GTSESATPESGPG | | GTACGTCTGAATCAGCCACGCCGGAGTCTGGTCC | |
| | TSTEPSEGSAPGT | | GGGTACCTCGACCGAACCAAGCGAAGGTTCGGCA | |
| | SESATPESGPGSE | | CCGGGTACTAGCGAGAGCGCAACCCCTGAAAGCG | |
| | PATSGSETPGTSE | | GTCCGGGCAGCCCGGCAGGTTCTCCAACCAGCAC | |
| | SATPESGPGSEPA | | CGAAGAAGGTTCCCCTGCTGGTAGCCCGACCTCT | |
| | TSGSETPGTSESA | | ACGGAGGAAGGTAGCCCTGCAGGTTCCCCAACTT | |
| | TPESGPGTSTEPS | | CTACTGAGGAAGGTACTTCTGAGTCCGCTACCCC | |
| | EGSAPGSPAGSPT | | AGAAAGCGGTCCTGGTACCTCCACTGAACCGTCT | |
| | STEEGTSESATPE | | GAAGGCTCTGCACCAGGCACTTCTGAGTCTGCTA | |
| | SGPGSEPATSGSE | | CTCCAGAAAGCGGCCCAGGTTCTGAACCAGCAAC | |
| | TPGTSESATPESG | | TTCTGGCTCTGAGACTCCAGGCACTTCTGAGTCC | |
| | PGSPAGSPTSTEE | | GCAACGCCTGAATCCGGTCCTGGTTCTGAACCAG | |
| | GSPAGSPTSTEEG | | CTACTTCCGGCAGCGAAACCCCAGGTACCTCTGA | |
| | TSTEPSEGSAPGT | | GTCTGCGACTCCAGAGTCTGGTCCTGGTACTTCC | |
| | SESATPESGPGTS | | ACTGAGCCTAGCGAGGGTTCCGCACCAGGTTCTC | |
| | ESATPESGPGTSE | | CGGCTGGTAGCCCGACCAGCACGGAGGAGGGTAC | |
| | SATPESGPGSEPA | | GTCTGAATCTGCAACGCCGGAATCGGGCCCAGGT | |
| | TSGSETPGSEPAT | | TCGGAGCCTGCAACGTCTGGCAGCGAAACCCCGG | |
| | SGSETPGSPAGSP | | GTACCTCCGAATCTGCTACACCGGAAAGCGGTCC | |
| | TSTEEGTSTEPSE | | TGGCAGCCCTGCTGGTTCTCCAACCTCTACCGAG | |
| | GSAPGTSTEPSEG | | GAGGGTTCACCGGCAGGTAGCCCGACTAGCACTG | |
| | SAPGSEPATSGSE | | AAGAAGGTACTAGCACGGAGCCGAGCGAGGGTAG | |
| | TPGTSESATPESG | | TGCTCCGGGTACGAGCGAGAGCGCAACGCCAGAG | |
| | PGTSTEPSEGSAP | | AGCGGTCCAGGCACCAGCGAATCGGCCACCCCTG | |
| | LSGRSDNHVPLSL | | AGAGCGGCCCAGGTACTTCTGAGAGCGCCACTCC | |
| | KMGGTAEAASASG | | TGAATCCGGCCCTGGTAGCGAGCCGGCAACCTCC | |
| | DIQMTQSPSSLSA | | GGCTCAGAAACTCCTGGTTCGGAACCAGCGACCA | |
| | SVGDRVTITCRAS | | GCGGTTCTGAAACTCCGGGTAGCCCGGCAGGCAG | |
| | QDIRNYLNWYQQK | | CCCAACGAGCACCGAAGAGGGTACCAGCACGGAA | |
| | PGKAPKLLIYYTS | | CCGAGCGAGGGTTCTGCCCCGGGTACTTCCACCG | |
| | RLESGVPSRFSGS | | AACCATCGGAGGGCTCTGCACCTGGTAGCGAACC | |
| | GSGTDYTLTISSL | | TGCGACGTCTGGTTCTGAAACGCCGGGTACCAGC | |
| | QPEDFATYYCQQG | | GAAAGCGCTACCCCAGAATCCGGTCCGGGCACTA | |
| | NTLPWTFGQGTKV | | GCACCGAGCCATCGGAGGGCTCCGCACCActgTC | |
| | EIKGATPPETGAE | | AggtCGTtctGATaacCATgttCCActgTCTctg | |
| | TESPGETTGGSAE | | AAAatgGGTGGCACCGCCGAAGCAGCTagcgcct | |
| | SEPPGEGEVQLVE | | ctGGCGACATCCAAATGACCCAATCACCGTCATC | |
| | SGGGLVQPGGSLR | | CCTGAGCGCCTCTGTTGGAGATCGTGTAACAATT | |
| | LSCAASGYSFTGY | | ACCTGCCGCGCCTCCCAAGACATCCGCAATTACT | |
| | TMNWVRQAPGKGL | | TAAACTGGTATCAGCAAAAACCCGGTAAGGCACC | |
| | EWVALINPYKGVS | | GAAATTGCTGATTTATTATACTTCACGCTTAGAG | |
| | TYNQKFKDRFTIS | | AGTGGGGTGCCGTCGCGCTTCAGTGGCTCAGGCA | |
| | VDKSKNTAYLQMN | | GTGGGACCGATTACACATTGACAATTTCATCACT | |
| | SLRAEDTAVYYCA | | GCAGCCAGAGGATTTTGCGACTTATTACTGTCAA | |
| | RSGYYGDSDWYFD | | CAGGGTAACACGCTTCCCTGGACCTTCGGGCAAG | |
| | VWGQGTLVTVSS | | GCACGAAAGTTGAGATCAAGGGCGCTACTCCCCC | |
| | | | TGAGACAGGAGCGGAAACGGAATCCCCTGGCGAG | |
| | | | ACGACGGGTGGTTCCGCAGAGTCGGAACCTCCTG | |
| | | | GTGAGGGCGAGGTGCAGCTGGTTGAAAGCGGTGG | |
| | | | CGGTCTGGTGCAACCAGGCGGTAGCCTGCGTCTG | |
| | | | AGCTGCGCGGCGAGCGGTTACAGCTTTACCGGTT | |
| | | | ATACCATGAACTGGGTTCGTCAAGCGCCAGGTAA | |
| | | | AGGTCTGGAGTGGGTGGCGCTGATCAACCCGTAC | |
| | | | AAGGGTGTTAGCACCTATAACCAGAAGTTCAAAG | |
| | | | ACCGTTTTACCATTAGCGTGGATAAGAGCAAAAA | |

TABLE 7-continued

T-cell binding compositions

| Construct Name | Amino Acid Sequence | SEQ ID NO: | DNA Sequence | SEQ ID NO: |
|---|---|---|---|---|
| | | | CACCGCGTACCTGCAAATGAACAGCCTGCGTGCG GAGGACACCGCTGTGTACTATTGCGCGCGTAGCG GTTACTATGGCGACAGCGACTGGTATTTTGATGT GTGGGGCCAAGGCACCCTGGTTACCGTGAGCTCC | |
| TBP-11 | HHHHHHGGSPAGS PTSTEEGTSESAT PESGPGTSTEPSE GSAPGSPAGSPTS TEEGTSTEPSEGS APGTSTEPSEGSA PGTSESATPESGP GSEPATSGSETPG SEPATSGSETPGS PAGSPTSTEEGTS ESATPESGPGTST EPSEGSAPGTSTE PSEGSAPGSPAGS PTSTEEGTSTEPS EGSAPGTSTEPSE GSAPGTSESATPE SGPGTSTEPSEGS APGTSESATPESG PGSEPATSGSETP GTSTEPSEGSAPG TSTEPSEGSAPGT SESATPESGPGTS ESATPESGPGSPA GSPTSTEEGTSES ATPESGPGSEPAT SGSETPGTSESAT PESGPGTSTEPSE GSAPGTSTEPSEG SAPGTSTEPSEGS APGTSTEPSEGSA PGTSTEPSEGSAP GTSTEPSEGSAPG SPAGSPTSTEEGT STEPSEGSAPGTS ESATPESGPGSEP ATSGSETPGTSES ATPESGPGSEPAT SGSETPGTSESAT PESGPGTSTEPSE GSAPGTSESATPE SGPGSPAGSPTST EEGSPAGSPTSTE EGSPAGSPTSTEE GTSESATPESGPG TSTEPSEGSAPGT SESATPESGPGSE PATSGSETPGTSE SATPESGPGSEPA TSGSETPGTSESA TPESGPGTSTEPS EGSAPGSPAGSPT STEEGTSESATPE SGPGSEPATSGSE TPGTSESATPESG PGSPAGSPTSTEE GSPAGSPTSTEEG TSTEPSEGSAPGT SESATPESGPGTSE ESATPESGPGTSE SATPESGPGSEPA TSGSETPGSEPAT SGSETPGSPAGSP TSTEEGTSTEPSE GSAPGTSTEPSEG SAPGSEPATSGSE TPGTSESATPESG PGTSTEPSEGSAP LSGRSDNHSPLGL AGSGTAEAASASG | 440 | CATCACCACCATCATCACggAGGTAGCCCAGCTG GTAGCCCAACCTCTACCGAAGAAGGTACCTCTGA ATCCGCTACTCCAGAATCCGGTCCTGGTACTAGC ACTGAGCCAAGCGAAGGTTCTGCTCCAGGCTCCC CGGCAGGTAGCCCTACCTCTACCGAAGAGGGCAC TAGCACCGAACCATCTGAGGGTTCCGCTCCTGGC ACCTCCACTGAACCGTCCGAAGGCAGTGCTCCGG GTACTTCCGAAAGCGCAACTCCGGAATCCGGCCC TGGTTCTGAGCCTGCTACTTCCGGCTCTGAAACT CCAGGTAGCGAGCCAGCGACTTCTGGTTCTGAAA CTCCAGGTTCACCGGCGGGTAGCCCGACGAGCAC GGAGGAAGGTACCTCTGAGTCGGCCACTCCTGAG TCCGGTCCGGGCACGAGCACCGAGCCGAGCGAGG GTTCAGCCCCGGGTACCAGCACGGAGCCGTCCGA GGGTAGCGCACCGGGTTCTCCGGCGGGCTCCCCT ACGTCTACGGAAGAGGGTACGTCCACTGAACCTA GCGAGGGCAGCGCGCCAGGCACCAGCACTGAACC GAGCGAAGGCAGCGCACCTGGCACTAGCGAGTCT GCGACTCCGGAGAGCGGTCCGGGTACGAGCACGG AACCAAGCGAAGGCAGCGCCCCAGGTACCTCTGA ATCTGCTACCCCAGAATCTGGCCCGGGTTCCGAG CCAGCTACCTCTGGTTCTGAAACCCCAGGTACTT CCACTGAACCAAGCGAAGGTAGCGCTCCTGGCAC TTCTACTGAACCATCCGAAGGTTCCGCTCCTGGT ACGTCTGAAAGCGCTACCCCTGAAAGCGGCCCAG GCACCTCTGAAAGCGCTACTCCTGAGAGCGGTCC AGGCTCTCCAGCAGGTTCTCCAACCTCCACTGAA GAAGGCACCTCTGAGTCTGCTACCCCTGAATCTG GTCCTGGCTCCGAACCTGCTACCTCTGGTTCCGA AACTCCAGGTACCTCGGAATCTGCGACTCCGGAA TCTGGCCCGGGCACGAGCACGGAGCCGTCGAGG GTAGCGCACCAGGTACCAGCACTGAGCCTTCTGA GGGCTCTGCACCGGGTACCTCCACGGAACCTTCG GAAGGTTCTGCGCCGGGTACCTCCACTGAGCCAT CCGAGGGTTCAGCACCAGGTACTAGCACGGAACC GTCCGAGGGCTCTGCACCAGGTACGAGCACCGAA CCGTCGGAGGGTAGCGCTCCAGGTAGCCCAGCGG GCTCTCCGACAAGCACCGAAGAAGGCACCAGCAC CGAGCCGTCCGAAGGTTCCGCACCAGGTACAAGC GAGAGCGCGACTCCTGAATCTGGTCCGGGTAGCG AGCCTGCAACCAGCGGTTCTGAGACGCCGGGCAC TTCCGAATCTGCGACCCCGGAGTCCGGTCCAGGT TCAGAGCCGGCGACGAGCGGTTCGGAAACGCCGG GTACGTCTGAATCAGCCACGCCGGAGTCTGGTCC GGGTACCTCGACCGAACCAAGCGAAGGTTCGGCA CCGGGTACTAGCGAGAGCGCAACCCCTGAAAGCG GTCCGGGCAGCCCGGCAGGTTCTCCAACCAGCAC CGAAGAAGGTTCCCCTGCTGGTAGCCCGACCTCT ACGGAGGAAGGTAGCCCTGCAGGTTCCCCAACTT CTACTGAGGAAGGTACTTCTGAGTCCGCTACCCC AGAAAGCGGTCCTGGTACCTCCACTGAACCGTCT GAAGGCTCTGCACCAGGCACTTCTGAGTCTGCTA CTCCAGAAAGCGGCCCAGGTTCTGAACCAGCAAC TTCTGGCTCTGAGACTCCAGGCACTTCTGAGTCC GCAACGCCTGAATCCGGTCCTGGTTCTGAACCAG CTACTTCCGGCAGCGAAACCCCAGGTTCTGAGCC GTCTGCGACTCCAGAGTCTGGTCCTGGTACTTCC ACTGAGCCTAGCGAGGGTTCCGCACCAGGTTCTC CGGCTGGTAGCCCGACCAGCACGGAGGAGGGTAC GTCTGAATCTGCAACGCCGGAATCGGGCCCAGGT TCGGAGCCTGCAACGTCTGGCAGCGAAACCCCGG GTACCTCCGAATCTGCTACACCGGAAAGCGGTCC TGGCAGCCCTGCTGGTTCTCCAACCTCTACCGAG GAGGGTTCACCGGCAGGTAGCCCGACTAGCGGTA AAGAAGGTACTAGCACGGAGCCGAGCGAGGGTAG TGCTCCGGGTACGAGCGAGAGCGCAACGCCAGAG AGCGGTCCAGGCACCAGCGAATCGGCCACCCCTG AGAGCGGCCCAGGTACTTCTGAGAGCGCCACTCC TGAATCCGGCCCTGGTAGCGAGCCGGCAACCTCC | 456 |

TABLE 7-continued

T-cell binding compositions

| Construct Name | Amino Acid Sequence | SEQ ID NO: | DNA Sequence | SEQ ID NO: |
|---|---|---|---|---|
| | EVQLVESGGGLVQ PGGSLRLSCAASG YSFTGYTMNWVRQ APGKGLEWVALIN PYKGVSTYNQKFK DRFTISVDKSKNT AYLQMNSLRAEDT AVYYCARSGYYGD SDWYFDVWGQGTL VTVSSGATPPETG AETESPGETTGGS AESEPPGEGDIQM TQSPSSLSASVGD RVTITCRASQDIR NYLNWYQQKPGKA PKLLIYYTSRLES GVPSRFSGSGSGT DYTLTISSLQPED FATYYCQQGNTLP WTFGQGTKVEIK | | GGCTCAGAAACTCCTGGTTCGGAACCAGCGACCA GCGGTTCTGAAACTCCGGGTAGCCCGGCAGGCAG CCCAACGAGCACCGAAGAGGGTACCAGCACGGAA CCGAGCGAGGGTTCTGCCCCGGGTACTTCCACCG AACCATCGGAGGGCTCTGCACCTGGTAGCGAACC TGCGACGTCTGGTTCTGAAACGCCGGGTACCAGC GAAAGCGCTACCCCAGAATCCGGTCCGGGCACTA GCACCGAGCCATCGGAGGGCTCCGCACCActgTC AggtCGTtctGATaacCATtccCCActgGGTctg GCTGGGTCTGGCACCGCCGAAGCAGCTagcgcct ctGGCGAGGTGCAGCTGGTTGAAAGCGGTGGCGG TCTGGTGCAACCAGGCGGTAGCCTGCGTCTGAGC TGCGCGGCGAGCGGTTACAGCTTTACCGGTTATA CCATGAACTGGGTTCGTCAAGCGCCAGGTAAAGG TCTGGAGTGGGTGGCGCTGATCAACCCGTACAAG GGTGTTAGCACCTATAACCAGAAGTTCAAAGACC GTTTTACCATTAGCGTGGATAAGAGCAAAAACAC CGCGTACCTGCAAATGAACAGCCTGCGTGCGGAG GACACCGCTGTGTACTATTGCGCGCGTAGCGGTT ACTATGGCGACAGCGACTGGTATTTTGATGTGTG GGGCCAAGGCACCCTGGTTACCGTGAGCTCCGGC GCTACTCCCCCTGAGACAGGAGCGGAAACGGAAT CCCCTGGCGAGACGACGGGTGGTTCCGCAGAGTC GGAACCTCCTGGTGAGGGCGACATCCAAATGACC CAATCACCGTCATCCCTGAGCGCCTCTGTTGGAG ATCGTGTAACAATTACCTGCCGCGCCTCCAAGA CATCCGCAATTACTTAAACTGGTATCAGCAAAAA CCCGGTAAGGCACCGAAATTGCTGATTTATTATA CTTCACGCTTAGAGAGTGGGGTGCCGTCGCGCTT CAGTGGCTCGGGTAGTGGGACCGATTACACATTG ACAATTTCATCACTGCAGCCAGAGGATTTTGCGA CTTATTACTGTCAACAGGGTAACACGCTTCCCTG GACCTTCGGGCAAGGCACGAAAGTTGAGATCAAG | |
| TBP-12 | HHHHHHGGSPAGS PTSTEEGTSESAT PESGPGTSTEPSE GSAPGSPAGSPTS TEEGTSTEPSEGS APGTSTEPSEGSA PGTSESATPESGP GSEPATSGSETPG SEPATSGSETPGS PAGSPTSTEEGTS ESATPESGPGTST EPSEGSAPGTSTE PSEGSAPGSPAGS PTSTEEGTSTEPS EGSAPGTSTEPSE GSAPGTSESATPE SGPGTSTEPSEGS APGTSESATPESG PGSEPATSGSETP GTSTEPSEGSAPG TSTEPSEGSAPGT SESATPESGPGTS ESATPESGPGSPA GSPTSTEEGTSES ATPESGPGSEPAT SGSETPGTSESAT PESGPGTSTEPSE GSAPGTSTEPSEG SAPGTSTEPSEGS APGTSTEPSEGSA PGTSTEPSEGSAP GTSTEPSEGSAPG SPAGSPTSTEEGT STEPSEGSAPGTS ESATPESGPGSEP ATSGSETPGTSES ATPESGPGSEPAT SGSETPGTSESAT PESGPGTSTEPSE GSAPGTSESATPE | 441 | CATCACCACCATCATCACggAGGTAGCCCAGCTG GTAGCCCAACCTCTACCGAAGAAGGTACCTCTGA ATCCGCTACTCCAGAATCCGGTCCTGGTACTAGC ACTGAGCCAAGCGAAGGTTCTGCTCCAGGCTCCC CGGCAGGTAGCCCTACCTCTACCGAAGAGGGCAC TAGCACCGAACCATCTGAGGGTTCCGCTCCTGGC ACCTCCACTGAACCGTCCGAAGGCAGTGCTCCGG GTACTTCCGAAAGCGCAACTCCGGAATCCGGCCC TGGTTCTGAGCCTGCTACTTCCGGCTCTGAAACT CCAGGTAGCGAGCCAGCGACTTCTGGTTCTGAAG CTCCAGGTTCACCGGCGGGTAGCCCGACGAGCAC GGAGGAAGGTACCTCTGAGTCGGCCACTCCTGAG TCCGGTCCGGGCACGAGCACCGAGCCGAGCGAGG GTTCAGCCCCGGGTACCAGCACGGAGCCGTCCGA GGGTAGCGCACCGGGTTCTCCGGCGGGCTCCCCT ACGTCTACGGAAGAGGGTACGTCCACTGAACCTA GCGAGGGCAGCGCGCCAGGCACCAGCACTGAACC GAGCGAAGGCAGCGCACCTGGCACTAGCGAGTCT GCGACTCCGGAGAGCGGTCCGGGTACGAGCACGG AACCAAGCGAAGGCAGCGCCCCAGGTACCTCTGA ATCTGCTACCCCAGAATCTGGCCCGGGTTCCGAG CCAGCTACCTCTGGTTCTGAAACCCCAGGTACTT CCACTGAACCAAGCGAAGGTAGCGCTCCTGGCAC TTCTACTGAACCATCCGAAGGTTCCGCTCCTGGT ACGTCTGAAAGCGCTACCCCTGAAAGCGGCCCAG GCACCTCTGAAAGCGCTACTCCTGAGAGCGGTCC AGGCTCTCCAGCAGGTTCTCCAACCTCCACTGAA GAAGGCACCTCTGAGTCTGCTACCCCTGAATCTG GTCCTGGCTCCGAACCTGCTACCTCTGGTTCCGA AACTCCAGGTACCTCGGAATCTGCGACTCCGGAA TCTGGCCCGGGCACGAGCACGGAGCCGTCTGAGG GTAGCGCACCAGGTACCAGCACTGAGCCTTCTGA GGGCTCTGCACCGGGTACCTCCACGGAACCTTCG GAAGGTTCTGCGCCGGGTACCTCCACTGAGCCAT CCGAGGGTTCAGCACCAGGTACTAGCACGGAAGA GTCCGAGGGCTCTGCACCAGGTACGAGCACCGAA CCGTCGGAGGGTAGCGCTCCAGGTAGCCCAGCGG GCTCTCCGACAAGCACCGAAGAAGGCACCAGCAC CGAGCCGTCCGAAGGTTCCGCACCAGGTACAAGC GAGAGCGCGACTCCTGAATCTGGTCCGGGTAGCG | 457 |

TABLE 7-continued

T-cell binding compositions

| Construct Name | Amino Acid Sequence | SEQ ID NO: | DNA Sequence | SEQ ID NO: |
|---|---|---|---|---|
| | SGPGSPAGSPTST EEGSPAGSPTSTE EGSPAGSPTSTEE GTSESATPESGPG TSTEPSEGSAPGT SESATPESGPGSE PATSGSETPGTSE SATPESGPGSEPA TSGSETPGTSESA TPESGPGTSTEPS EGSAPGSPAGSPT STEEGTSESATPE SGPGSEPATSGSE TPGTSESATPESG PGSPAGSPTSTEE GSPAGSPTSTEEG TSTEPSEGSAPGT SESATPESGPGTS ESATPESGPGTSE SATPESGPGSEPA TSGSETPGSEPAT SGSETPGSPAGSP TSTEEGTSTEPSE GSAPGTSTEPSEG SAPGSEPATSGSE TPGTSESATPESG PGTSTEPSEGSAP LSGRSDNHVPLSL KMGGTAEAASASG EVQLVESGGGLVQ PGGSLRLSCAASG YSFTGYTMNWVRQ APGKGLEWVALIN PYKGVSTYNQKFK DRFTISVDKSKNT AYLQMNSLRAEDT AVYYCARSGYYGD SDWYFDVWGQGTL VTVSSGATPPETG AETESPGETTGGS AESEPPGEGDIQM TQSPSSLSASVGD RVTITCRASQDIR NYLNWYQQKPGKA PKLLIYYTSRLES GVPSRFSGSGSGT DYTLTISSLQPED FATYYCQQGNTLP WTFGQGTKVEIK | | AGCCTGCAACCAGCGGTTCTGAGACGCCGGGCAC TTCCGAATCTGCGACCCCGGAGTCCGGTCCAGGT TCAGAGCCGGCGACGAGCGGTTCGGAAACGCCGG GTACGTCTGAATCAGCCACGCCGGAGTCTGGTCC GGGTACCTCGACCGAACCAAGCGAAGGTTCGGCA CCGGGTACTAGCGAGAGCGCAACCCCTGAAAGCG GTCCGGGCAGCCCGGCAGGTTCTCCAACCAGCAC CGAAGAAGGTTCCCCTGCTGGTAGCCCGACCTCT ACGGAGGAAGGTAGCCCTGCAGGTTCCCCAACTT CTACTGAGGAAGGTACTTCTGAGTCCGCTACCCC AGAAAGCGGTCCTGGTACCTCCACTGAACCGTCT GAAGGCTCTGCACCAGGCACTTCTGAGTCTGCTA CTCCAGAAAGCGGCCCAGGTTCTGAACCAGCAAC TTCTGGCTCTGAGACTCCAGGCACTTCTGAGTCC GCAACGCCTGAATCCGGTCCTGGTTCTGAACCAG CTACTTCCGGCAGCGAAACCCCAGGTACCTCTGA GTCTGCGACTCCAGAGTCTGGTCCTGGTACTTCC ACTGAGCCTAGCGAGGGTTCCGCACCAGGTTCTC CGGCTGGTAGCCCGACCAGCACGGAGGAGGTAC GTCTGAATCTGCAACGCCGGAATCGGGCCCAGGT TCGGAGCCTGCAACGTCTGGCAGCGAAACCCCGG GTACCTCCGAATCTGCTACACCGGAAAGCGGTCC TGGCAGCCCTGCTGGTTCTCCAACCTCTACCGAG GAGGGTTCACCGGCAGGTAGCCCGACTAGCACTG AAGAAGGTACTAGCACGGAGCCGAGCGAGGGTAG TGCTCCGGGTACGAGCGAGAGCGCAACGCCAGAG AGCGGTCCAGGCACCAGCGAATCGGCCACCCCTG AGAGCGGCCCAGGTACTTCTGAGAGCGCCACTCC TGAATCCGGCCCTGGTAGCGAGCCGGCAACCTCC GGCTCAGAAACTCCTGGTTCGGAACCAGCGACCA GCGGTTCTGAAACTCCGGGTAGCCGGCAGGCAG CCCAACGAGCACCGAAGAGGGTACCAGCACGGAA CCGAGCGAGGGTTCTGCCCCGGGTACTTCCACCG AACCATCGGAGGGCTCTGCACCTGGTAGCGAACC TGCGACGTCTGGTTCTGAAACGCCGGGTACCAGC GAAAGCGCTACCCCAGAATCCGGTCCGGGCACTA GCACCGAGCCATCGGAGGGCTCCGCACCActgTC AggtCGTtctGATaacCATgttCCActgTCTctg AAAatgGGTGGCACCGCCGAAGCAGCTagcgcct ctGGCGAGGTGCAGCTGGTTGAAAGCGGTGGCGG TCTGGTGCAACCAGCGGTAGCCTGCTCTGAGC TGCGCGGCGAGCGGTTACAGCTTTACCGGTTATA CCATGAACTGGGTTCGTCAAGCGCCAGGTAAAGG TCTGGAGTGGGTGGCGCTGATCAACCCGTACAAG GGTGTTAGCACCTATAACCAGAAGTTCAAAGACC GTTTTACCATTAGCGTGGATAAGAGCAAAAACAC CGCGTACCTGCAAATGAACAGCCTGCGTGCGGAG GACACCGCTGTGTACTATTGCGCGCGTAGCGGTT ACTATGGCGACAGCGACTGGTATTTTGATGTGTG GGGCCAAGGCACCCTGGTTACCGTGAGCTCCGGC GCTACTCCCCCTGAGACAGGAGCGGAAACGGAAT CCCCTGGCGAGACGACGGGTGGTTCCGCAGAGTC GGAACCTCCTGGTGAGGGCGACATCCAAATGACC CAATCACCGTCATCCCTGAGCGCCTCTGTTGGAG ATCGTGTAACAATTACCTGCCGCGCCTCCAAGA CATCCGCAATTACTTAAACTGGTATCAGCAAAA CCCGGTAAGGCACCGAAATTGCTGATTTATTATA CTTCACGCTTAGAGAGTGGGGTGCCGTCGCGCTT CAGTGGCTCGGGTAGTGGGACCGATTACACATTG ACAATTTCATCACTGCAGCCAGAGGATTTTGCGA CTTATTACTGTCAACAGGGTAACACGCTTCCCTG GACCTTCGGGCAAGGCACGAAAGTTGAGATCAAG | |
| TBP-13 | HHHHHHGGSPAGS PTSTEEGTSESAT PESGPGTSTEPSE GSAPGSPAGSPTS TEEGTSTEPSEGS APGTSTEPSEGSA PGTSESATPESGP GSEPATSGSETPG SEPATSGSETPGS PAGSPTSTEEGTS ESATPESGPGTST | 442 | CATCACCACCATCATCACggAGGTAGCCCAGCTG GTAGCCCAACCTCTACCGAAGAAGGTACCTCTGA ATCCGCTACTCCAGAATCCGGTCCTGGTACTAGC ACTGAGCCAAGCGAAGGTTCTGCTCCAGGCTCCC CGGCAGGTAGCCCTACCTCTACCGAAGAGGGCAC TAGCACCGAACCATCTGAGGGTTCCGCTCCTGGC GTACTTCCGAAAGCGCAACTCCGGAATCCGGCCC ACCTCCACTGAACCGTCCGAAGGCAGTGCTCCGG GTACTTCCGAAAGCGCAACTCCGGAATCCGGCCC TGGTTCTGAGCCTGCTACTTCCGGCTCTGAAACT CCAGGTAGCGAGCCAGCGACTTCTGGTTCTGAAA CTCCAGGTTCACCGGCGGGTAGCCCGACGAGCAC | 458 |

TABLE 7-continued

T-cell binding compositions

| Construct Name | Amino Acid Sequence | SEQ ID NO: | DNA Sequence | SEQ ID NO: |
|---|---|---|---|---|
| | EPSEGSAPGTSTE | | GGAGGAAGGTACCTCTGAGTCGGCCACTCCTGAG | |
| | PSEGSAPGSPAGS | | TCCGGTCCGGGCACGAGCACCGAGCCGAGCGAGG | |
| | PTSTEEGTSTEPS | | GTTCAGCCCCGGGTACCAGCACGGAGCCGTCCGA | |
| | EGSAPGTSTEPSE | | GGGTAGCGCACCGGGTTCTCCGGCGGGCTCCCCT | |
| | GSAPGTSESATPE | | ACGTCTACGGAAGAGGGTACGTCCACTGAACCTA | |
| | SGPGTSTEPSEGS | | GCGAGGGCAGCGCGCCAGGCACCAGCACTGAACC | |
| | APGTSESATPESG | | GAGCGAAGGCAGCGCACCTGGCACTAGCGAGTCT | |
| | PGSEPATSGSETP | | GCGACTCCGGAGAGCGGTCCGGGTACGAGCACGG | |
| | GTSTEPSEGSAPG | | AACCAAGCGAAGGCAGCGCCCCAGGTACCTCTGA | |
| | TSTEPSEGSAPGT | | ATCTGCTACCCCAGAATCTGGCCCGGGTTCCGAG | |
| | SESATPESGPGTS | | CCAGCTACCTCTGGTTCTGAAACGCCAGGTACTT | |
| | ESATPESGPGSPA | | CCACTGAACCAAGCGAAGGTAGCGCTCCTGGCAC | |
| | GSPTSEEGTSESA | | TTCTACTGAACCATCCGAAGGTTCCGCTCCTGGT | |
| | ATPESGPGSEPAT | | ACGTCTGAAAGCGCTACCCCTGAAAGCGGCCCAG | |
| | SGSETPGTSESAT | | GCACCTCTGAAAGCGCTACTCCTGAGAGCGGTCC | |
| | PESGPGTSTEPSE | | AGGCTCTCCAGCAGGTTCTCCAACCTCCACTGAA | |
| | GSAPGTSTEPSEG | | GAAGGCACCTCTGAGTCTGCTACCCCTGAATCTG | |
| | SAPGTSTEPSEGS | | GTCCTGGCTCCGAACCTGCTACCTCTGGTTCCGA | |
| | APGTSTEPSEGSA | | AACTCCAGGTACCTCGGAATCTGCGACTCCGGAA | |
| | PGTSTEPSEGSAP | | TCTGGCCCGGGCACGAGCACGGAGCCGTCTGAGG | |
| | GTSTEPSEGSAPG | | GTAGCGCACCAGGTACCAGCACTGAGCCTTCTGA | |
| | SPAGSPTSTEEGT | | GGGCTCTGCACCGGGTACCTCCACGGAACCTTCG | |
| | STEPSEGSAPGTS | | GAAGGTTCTGCGCCGGGTACCTCCACTGAGGCAT | |
| | ESATPESGPGSEP | | CCGAGGGTTCAGCACCAGGTACTAGCACGGAACC | |
| | ATSGSETPGTSES | | GTCCGAGGGCTCTGCACCAGGTACGAGCACCGAA | |
| | ATPESGPGSEPAT | | CCGTCGGAGGGTAGCGCTCCAGGTAGCCCAGCGG | |
| | SGSETPGTSESAT | | GCTCTCCGACAAGCACCGAAGAAGGCACCAGCAC | |
| | PESGPGTSTEPSE | | CGAGCCGTCCGAAGGTTCCGCACCAGGTACAAGC | |
| | GSAPGTSESATPE | | GAGAGCGCGACTCCTGAATCTGGTCCGGGTAGCG | |
| | SGPGSPAGSPTST | | AGCCTGCAACCAGCGGTTCTGAGACGCCGGGCAC | |
| | EEGSPAGSPTSTE | | TTCCGAATCTGCGACCCCGGAGTCCGGTCCAGGT | |
| | EGSPAGSPTSTEE | | TCAGAGCCGGCGACGAGCGGTTCCGAACCGCCGG | |
| | GTSESATPESGPG | | GTACGTCTGAATCAGCCACGCCGGAGTCTGGTCC | |
| | TSTEPSEGSAPGT | | GGGTACCTCGACCGAACCAAGCGAAGGTTCGGCA | |
| | SESATPESGPGSE | | CCGGGTACTAGCGAGAGCGCAACCCCTGAAAGCG | |
| | PATSGSETPGTSE | | GTCCGGGCAGCCCGGCAGGTTCTCCAACCAGCAC | |
| | SATPESGPGSEPA | | CGAAGAAGGTTCCCCTGCTGGTAGCCCCGACCTCT | |
| | TSGSETPGTSESA | | ACGGAGGAAGGTAGCCCTGCAGGTTCCCCAACTT | |
| | TPESGPGTSTEPS | | CTACTGAGGAAGGTACTTCTGAGTCCGCTACCCC | |
| | EGSAPGSPAGSPT | | AGAAAGCGGTCCTGGTACCTCCACTGAAGCCAGC | |
| | STEEGTSESATPE | | GAAGGCTCTGCACCAGGCACTTCTGAGTCTGCTA | |
| | SGPGSEPATSGSE | | CTCCAGAAAGCGGCCCAGGTTCTGAACCAGCAAC | |
| | TPGTSESATPESG | | TTCTGGCTCTGAGACTCCAGGCACTTCTGAGTCC | |
| | PGSPAGSPTSTEE | | GCAACGCCTGAATCCGGTCCTGGTTCTGAACCAG | |
| | GSPAGSPTSTEEG | | CTACTTCCGGCAGCGAAACCCCAGGTACCTCTGA | |
| | TSTEPSEGSAPGT | | GTCTGCGACTCCAGAGTCTGGTCCTGGTACTTCC | |
| | SESATPESGPGTS | | ACTGAGCCTAGCGAGGGTTCCGCACCAGGTTCTC | |
| | ESATPESGPGTSE | | CGGCTGGTAGCCCGACCAGCACGGAGGAGGGTAC | |
| | SATPESGPGSEPA | | GTCTGAATCTGCAACGCCGGAATCGGGCCCAGGT | |
| | TSGSETPGSEPAT | | TCGGAGCCTGCAACGTCTGGCAGCGAAACCCCGG | |
| | SGSETPGSPAGSP | | GTACCTCCGAATCTGCTACACCGGAAAGCGGTCC | |
| | TSTEEGTSTEPSE | | TGGCAGCCCTGCTGGTTCTCCAACCTCTACCGAG | |
| | GSAPGTSTEPSEG | | GAGGGTTCACCGGCAGGTAGCCCGACTAGCACTG | |
| | SAPGSEPATSGSE | | AAGAAGGTACTAGCACGGAGCCGAGCGAGGGTAG | |
| | TPGTSESATPESG | | TGCTCCGGGTACGAGCGAGAGCGCAACGCCAGAG | |
| | PGTSTEPSEGSAP | | AGCGGTCCAGGCACCAGCGAATCGGCCACCCCTG | |
| | LSGRSDNHSPLGL | | AGAGCGGCCCAGGTACTTCTGAGAGCGCCACTCC | |
| | AGSGTAEAASASG | | TGAATCCGGCCCTGGTAGCGAGCCGGCAACCTCC | |
| | ELVVTQEPSLTVS | | GGCTCAGAAACTCCTGGTTCGGAACCAGCGACCA | |
| | PGGTVTLTCRSST | | GCGGTTCTGAAACTCCGGGTAGCCCGGCAGGCAG | |
| | GAVTTSNYANWVQ | | CCCAACGAGCACCGAAGAGGGTACCAGCACCGAA | |
| | QKPGQAPRGLIGG | | CCGAGCGAGGGTTCTGCCCCGGGTACTTCCACCG | |
| | TNKRAPGTPARFS | | AACCATCGGAGGGCTCTGCACCTGGTAGCGAACC | |
| | GSLLGGKAALTLS | | TGCGACGTCTGGTTCTGAAACGCCGGGTACCAGC | |
| | GVQPEDEAEYYCA | | GAAAGCGCTACCCCAGAATCCGGTCCGGCAGGCA | |
| | LWYSNLWVFGGGT | | GCACCGAGCCATCGGAGGGCTCCGCACCActgTC | |
| | KLTVLGATPPETG | | AggtCGTtctGATaacCATtccCCActgGGTctg | |
| | AETESPGETTGGS | | GCTGGGTCTGGCACCGCCGAAGCAGCTagcgcct | |
| | AESEPPGEGEVQL | | ctGGCGAACTGGTCGTCACGCAGGAGCCGTCCCT | |
| | LESGGGLVQPGGS | | TACCGTTTCACCAGGTGGAACAGTGACTCTGACG | |
| | LKLSCAASGFTFN | | TGTCGCTCCTCCACTGGGGCGGTTACAACTTCCA | |
| | TYAMNWVRQAPGK | | ATTATGCTAATTGGGTCCAGCAGAAGCCGGGCCA | |
| | GLEWVARIRSKYN | | AGCCCCTCGCGGGTTGATTGGCGGCACCAACAAA | |
| | NYATYYADSVKDR | | CGTGCTCCAGGGACACCTGCCCGTTTTTCGGGCT | |

TABLE 7-continued

T-cell binding compositions

| Construct Name | Amino Acid Sequence | SEQ ID NO: | DNA Sequence | SEQ ID NO: |
|---|---|---|---|---|
| | FTISRDDSKNTAY LQMNNLKTEDTAV YYCVRHGNFGNSY VSWFAYWGQGTLV TVSS | | CCTTATTGGGGGCAAAGCTGCACTGACGTTGTC TGGAGTTCAGCCGGAGGATGAGGCAGAGTATTAC TGCGCATTGTGGTATTCTAATTTATGGGTTTTTG GAGGCGGCACAAAGCTGACCGTCCTGggtgcgac cccgccggaaaccggtgcggaaaccgaaagcccg ggtgaaaccaccggtggcagcgcggagagcgaac cgccgggtgaaggtGAGGTTCAGTTGTTGGAAAG CGGGGGCGGGCTTGTCCAACCTGGAGGTTCATTA AAATTGAGCTGTGCAGCCTCCGGATTCACCTTTA ACACGTATGCAATGAACTGGGTCCGTCAAGCGCC CGGTAAGGGGCTGGAGTGGGTAGCTCGCATCCGC TCGAAGTATAATAATTACGCAACCTACTACGCAG ACAGTGTCAAAGATCGCTTCACTATCTCACGCGA CGACAGTAAGAACACGGCCTACTTACAGATGAAC AATCTTAAAACGGAGGACACCGCTGTCTACTACT GCGTGCGCCACGGGAATTTCGGTAACTCTTATGT AAGTTGGTTCGCATATTGGGGACAAGGTACGTTG GTAACCGTATCCAGC | |
| TBP-14 | HHHHHHGGSPAGS PTSTEEGTSESAT PESGPGTSTEPSE GSAPGSPAGSPTS TEEGTSTEPSEGS APGTSTEPSEGSA PGTSESATPESGP GSEPATSGSETPG SEPATSGSETPGS PAGSPTSTEEGTS ESATPESGPGTST EPSEGSAPGTSTE PSEGSAPGSPAGS PTSTEEGTSTEPS EGSAPGTSTEPSE GSAPGTSESATPE SGPGTSTEPSEGS APGTSESATPESG PGSEPATSGSETP GTSTEPSEGSAPG TSTEPSEGSAPGT SESATPESGPGTS ESATPESGPGSPA GSPTSTEEGTSES ATPESGPGSEPAT SGSETPGTSESAT PESGPGTSTEPSE GSAPGTSTEPSEG SAPGTSTEPSEGS APGTSTEPSEGSA PGTSTEPSEGSAP GTSTEPSEGSAPG SPAGSPTSTEEGT STEPSEGSAPGTS ESATPESGPGSEP ATSGSETPGTSES ATPESGPGSEPAT SGSETPGTSESAT PESGPGTSTEPSE GSAPGTSESATPE SGPGSPAGSPTST EEGSPAGSPTSTE EGSPAGSPTSTEE GTSESATPESGPG TSTEPSEGSAPGT SESATPESGPGSE PATSGSETPGTSE SATPESGPGSEPA TSGSETPGTSESA TPESGPGTSTEPS EGSAPGSPAGSPT STEEGTSESATPE SGPGSEPATSGSE TPGTSESATPESG PGSPAGSPTSTEE | 443 | CATCACCACCATCATCACggAGGTAGCCCAGCTG GTAGCCCAACCTCTACCGAAGAAGGTACCTCTGA ATCCGCTACTCCAGAATCCGGTCCTGGTACTAGC ACTGAGCCAAGCGAAGGTTCTGCTCCAGGCTCCG CGGCAGGTAGCCCTACCTCTACCGAAGAGGGCAC TAGCACCGAACCATCTGAGGGTTCCGCTCCTGGC ACCTCCACTGAACCGTCCGAAGGCAGTGCTCCGG GTACTTCCGAAAGCGCAACTCCGGAATCGGCCC TGGTTCTGAGCCTGCTACTTCCGGCTCTGAAACT CCAGGTAGCGAGCCAGCGACTTCTGGTTCTGAAA CTCCAGGTTCACCGGCGGGTAGCCCGACGAGCAC GGAGGAAGGTACCTCTGAGTCGGCCACTCCTGAG TCCGGTCCGGGCACGAGCACCGAGCCGAGCGAGG GTTCAGCCCGGGTACCAGCACGGAGCCGTCCGA GGGTAGCGCACCGGGTTCTCCGGCGGGCTCCCCT ACGTCTACGGAAGAGGGTACGTCCACTGAACCTA GCGAGGGCAGCGCGCCAGGCACCAGCACTGAACC GAGCGAAGGCAGCGCACCTGGCACTAGCGAGTCT GCGACTCCGGAGAGCGGTCCGGGTACGAGCACGG AACCAAGCGAAGGCAGCGCCCCAGGTACCTCTGA ATCTGCTACCCCAGAATCTGGCCCGGGTTCCGAG CCAGCTACCTCTGGTTCTGAAACCCCAGGTACTT CCACTGAACCAAGCGAAGGTAGCGCTCCTGGCAC TTCTACTGAACCATCCGAAGGTTCCGCTCCTGGT ACGTCTGAAAGCGCTACCCCTGAAAGCGGCCCAG GCACCTCTGAAAGCGCTACTCCTGAGAGCGGTCC AGGCTCTCCAGCAGGTTCTCCAACCTCCACTGAA GAAGGCACCTCTGAGTCTGCTACCCCTGAATCTG GTCCTGGCTCCGAACCTGCTACCTCTGGTTCCGA AACTCCAGGTACCTCGGAATCTGCGACTCCGGAA TCTGGCCCGGGCACGAGCACGGAGCCGTCTGAGG GTAGCGCACCAGGTACCAGCACTGAGCCTTCTGA GGGCTCTGCACCGGGTACCTCCACGGAACCTTCG GAAGGTTCTGCGCCGGGTACCTCCACTGAGCCAT CCGAGGGTTCAGCACCAGGTACTAGCACGGAACC GTCCGAGGGCTCTGCACCAGGTACGAGCACCGAA CCGTCGGAGGGTAGCGCTCCAGGTACCAGCACGG GCTCTCCGACAAGCACCGAAGAAGGCACCAGCGA CGAGCCGTCCGAAGGTTCCGCACCAGGTACAAGC GAGAGCGCGACTCCTGAATCTGGTCCGGGTAGCG AGCCTGCAACCAGCGGTTCTGAGACGCCGGGCAC TTCCGAATCTGCGACCCCGGAGTCCGGTCCAGGT TCAGAGCCGGCGACGAGCGGTTCGGAAACGCCGG GTACGTCTGAATCAGCCACGCCGGAGTCTGGTCC GGGTACCTCGACCGAACCAAGCGAAGGTTCGGCA CCGGGTACTAGCGAGAGCGCAACCCCTGAAAGCG GTCCGGGCAGCCCGGCAGGTTCTCCAACCAGCAC CGAAGAAGGTTCCCCTGCTGGTAGCCCGACCTCT ACGGAGGAAGGTAGCCCTGCAGGTTCCCCAACTT CTACTGAGGAAGGTACTTCTGAGTCCGCTACTCC AGAAAGCGGTCCTGGTACCTCCACTGAACCGTCT GAAGGCTCTGCACCAGGCACTTCTGAGTCTGCTA CTCCAGAAAGCGGCCCAGGTTCTGAACCAGCAAC TTCTGGCTCTGAGACTCCAGGCACTTCTGAGTCC GCAACGCCTGAATCCGGTCCTGGTTCTGAACCAG | 459 |

TABLE 7-continued

T-cell binding compositions

| Construct Name | Amino Acid Sequence | SEQ ID NO: | DNA Sequence | SEQ ID NO: |
|---|---|---|---|---|
| | GSPAGSPTSTEEG TSTEPSEGSAPGT SESATPESGPGTS ESATPESGPGTSE SATPESGPGSEPA TSGSETPGSEPAT SGSETPGSPAGSP TSTEEGTSTEPSE GSAPGTSTEPSEG SAPGSEPATSGSE TPGTSESATPESG PGTSTEPSEGSAP LSGRSDNHVPLSL KMGGTAEAASASG ELVVTQEPSLTVS PGGTVTLTCRSST GAVTTSNYANWVQ QKPGQAPRGLIGG TNKRAPGTPARFS GSLLGGKAALTLS GVQPEDEAEYYCA LWYSNLWVFGGGT KLTVLGATPPETG AETESPGETTGGS AESEPPGEGEVQL LESGGGLVQPGGS LKLSCAASGFTFN TYAMNWVRQAPGK GLEWVARIRSKYN NYATYYADSVKDR FTISRDDSKNTAY LQMNNLKTEDTAV YYCVRHGNFGNSY VSWFAYWGQGTLV TVSS | | CTACTTCCGGCAGCGAAACCCCAGGTACCTCTGA GTCTGCGACTCCAGAGTCTGGTCCTGGTACTTCC ACTGAGCCTAGCGAGGGTTCCGCACCAGGTTCTC CGGCTGGTAGCCCGACCAGCACGGAGGAGGGTAC GTCTGAATCTGCAACGCCGGAATCGGGCCCAGGT TCGGAGCCTGCAACGTCTGGCAGCGAAACCCCGG GTACCTCCGAATCTGCTACACCGGAAAGCGGTCC TGGCAGCCCTGCTGGTTCTCCAACCTCTACCGAG GAGGGTTCACCGGCAGGTAGCCCGACTAGCACTG AAGAAGGTACTAGCACGGAGCCGAGCGAGGGTAG TGCTCCGGGTACGAGCGAGAGCGCAACGCCAGAG AGCGGTCCAGGCACCAGCGAATCGGCCACCCCTG AGAGCGGCCCAGGTACTTCTGAGAGCGCCACTCC TGAATCCGGCCCTGGTAGCGAGCCGGCAACCTCC GGCTCAGAAACTCCTGGTTCGGAACCGGACCA GCGGTTCTGAAACTCCGGGTAGCCCGGCAGGCAG CCCAACGAGCACCGAAGAGGGTACCAGCACGGAA CCGAGCGAGGGTTCTGCCCCGGGTACTTCCACCG AACCATCGGAGGGCTCTGCACCTGGTAGCGAACC TGCGACGTCTGGTTCTGAAACGCCGGGTACCAGC GAAAGCGCTACCCCAGAATCCGGTCCGGGCACTA GCACCGAGCCATCGGAGGGCTCCGCACCActgTC AggtCGTtctGATaacCATgttCCActgTCTctg AAAatgGGTGGCACCGCCGAAGCAGCTAgcgcct ctGGCGAACTGGTCGTCACGCAGGAGCCGTCCCT TACCGTTTCACCAGGTGGAACAGTGACTCTGACG TGTCGCTCCTCCACTGGGGCGGTTACAACTTCCA ATTATGCTAATTGGGTCCAGCAGAAGCCGGGCCA AGCCCCTCGCGGGTTGATTGGCGGCACCAACAAA CGTGCTCCAGGGACACCTGCCCGTTTTTCGGGCT CCTTATTGGGGGCAAAGCTGCACTGACGTTGTC TGGAGTTCAGCCGGAGGATGAGGCAGAGTATTAC TGCGCATTGTGGTATTCTAATTTATGGGTTTTTG GAGGCGGCACAAAGCTGACCGTCCTGggtgcgac cccgccggaaaccggtgcggaaaccgaaagcccg ggtgaaaccaccggtggcagcgcggagagcgaac cgccgggtgaaggtGAGGTTCAGTTGTTGGAAAG CGGGGGCGGGCTTGTCCAACCTGGAGGTTCATTA AAATTGAGCTGTGCAGCCTCCGGATTCACCTTTA ACACGTATGCAATGAACTGGGTCCGTCAAGCGCC CGGTAAGGGGCTGGAGTGGGTAGCTCGCATCCGC TCGAAGTATAATAATTACGCAACCTACTACGCAG ACAGTGTCAAAGATCGCTTCACTATCTCACGCGA CGACAGTAAGAACACGGCCTACTTACAGATGAAC AATCTTAAAACGGAGGACACCGCTGTCTACTACT GCGTGCGCCACGGGAATTTCGGTAACTCTTATGT AAGTTGGTTCGCATATTGGGGACAAGGTACGTTG GTAACCGTATCCAGC | |
| TBP-15 | HHHHHHGGSPAGS PTSTEEGTSESAT PESGPGTSTEPSE GSAPGSPAGSPTS TEEGTSTEPSEGS APGTSTEPSEGSA PGTSESATPESGP GSEPATSGSETPG SEPATSGSETPGS PAGSPTSTEEGTS ESATPESGPGTST EPSEGSAPGTSTE PSEGSAPGSPAGS PTSTEEGTSTEPS EGSAPGTSTEPSE GSAPGTSESATPE SGPGTSTEPSEGS APGTSESATPESG PGSEPATSGSETP GTSTEPSEGSAPG TSTEPSEGSAPGT SESATPESGPGTS ESATPESGPGSPA GSPTSTEEGTSES ATPESGPGSEPAT | 444 | CATCACCACCATCATCACggAGGTAGCCCAGCTG GTAGCCCAACCTCTACCGAAGAAGGTACCTCTGA ATCCGCTACTCCAGAATCCGGTCCTGGTACTAGC ACTGAGCCAAGCGAAGGTTCTGCTCCAGGCTCCC CGGCAGGTAGCCCTACCTCTACCGAAGAGGGCAC TAGCACCGAACCATCTGAGGGTTCCGCTCCTGGC ACCTCCACTGAACCGTCCGAAGGCAGTGCTCCGG GTACTTCCGAAAGCGCAACTCCGGAATCCGGTCC TGGTTCTGAGCCTGCTACTTCCGGCTCTGAAACT CCAGGTAGCGAGCCAGCGACTTCTGGTTCTGAAA CTCCAGGTTCACCGGCGGGTAGCCCGACGAGCAC GGAGGAAGGTACCTCTGAGTCGGCCACTCCTGA TCCGGTCCGGGCACGAGCACCGAGCCGAGCGAGG GTTCAGCCCCGGGTACCAGCACGGAGCCGTCCGA GGGTAGCGCACCGGGTTCTCCGGCGGGCTCCCCT ACGTCTACGGAAGAGGGTACGTCCACTGAACCTA GCGAGGGCAGCGCGCCAGGCACCAGCACTGAACC GAGCGAAGGCAGCGCACCTGGCACTAGCGAGTCT GCGACTCCGGAGAGCGGTCCGGGTACGAGCACGG AACCAAGCGAAGGCAGCGCCCCAGGTACCTCTGA ATCTGCTACCCCAGAATCTGGCCCGGGTTCCGAG CCAGCTACCTCTGGTTCTGAAACCCCAGGTACTT CCACTGAACCAAGCGAAGGTAGCGCTCCTGGCAC TTCTACTGAACCATCCGAAGGTTCCGCTCCTGGT ACGTCTGAAAGCGCTACCCCTGAAAGCGGCCCAG | 460 |

TABLE 7-continued

T-cell binding compositions

| Construct Name | Amino Acid Sequence | SEQ ID NO: | DNA Sequence | SEQ ID NO: |
|---|---|---|---|---|
| | SGSETPGTSESAT PESGPGTSTEPSE GSAPGTSTEPSEG SAPGTSTEPSEGS APGTSTEPSEGSA PGTSTEPSEGSAP GTSTEPSEGSAPG SPAGSPTSTEEGT STEPSEGSAPGTS ESATPESGPGSEP ATSGSETPGTSES ATPESGPGSEPAT SGSETPGTSESAT PESGPGTSTEPSE GSAPGTSESATPE SGPGSPAGSPTST EEGSPAGSPTSTE EGSPAGSPTSTEE GTSESATPESGPG TSTEPSEGSAPGT SESATPESGPGSE PATSGSETPGTSE SATPESGPGSEPA TSGSETPGTSESA TPESGPGTSTEPS EGSAPGSPAGSPT STEEGTSESATPE SGPGSEPATSGSE TPGTSESATPESG PGSPAGSPTSTEE GSPAGSPTSTEEG TSTEPSEGSAPGT SESATPESGPGTS ESATPESGPGTSE SATPESGPGSEPA TSGSETPGSEPAT SGSETPGSPAGSP TSTEEGTSTEPSE GSAPGTSTEPSEG SAPGSEPATSGSE TPGTSESATPESG PGTSTEPSEGSAP LSGRSDNHSPLGL AGSGTAEAASASG EVQLLESGGGLVQ PGGSLKLSCAASG FTFNTYAMNWVRQ APGKGLEWVARIR SKYNNYATYYADS VKDRFTISRDDSK NTAYLQMNNLKTE DTAVYYCVRHGNF GNSYVSWFAYWGQ GTLVTVSSGATPP ETGAETESPGETT GGSAESEPPGEGE LVVTQEPSLTVSP GGTVTLTCRSSTG AVTTSNYANWVQQ KPGQAPRGLIGGT NKRAPGTPARFSG SLLGGKAALTLSG VQPEDEAEYYCAL WYSNLWVFGGGTK LTVL | | GCACCTCTGAAAGCGCTACTCCTGAGAGCGGTCC AGGCTCTCCAGCAGGTTCTCCAACCTCCACTGAA GAAGGCACCTCTGAGTCTGCTACCCCTGAATCTG GTCCTGGCTCCGAACCTGCTACCTCTGGTTCCGA AACTCCAGGTACCTCGGAATCTGCGACTCCGGAA TCTGGCCCGGGCACGAGCACGGAGCCGTCTGAGG GTAGCGCACCAGGTACCAGCACTGAGCCTTCTGA GGGCTCTGCACCGGGTACCTCCACGGAACCTTCG GAAGGTTCTGCGCCGGGTACCTCCACTGAGCCAT CCGAGGGTTCAGCACCAGGTACTAGCACGGAACC GTCCGAGGGCTCTGCACCAGGTACGAGCGAGTCA CCGTCGGAGGGTAGCGCTCCAGGTAGCCCCAGCGG GCTCTCCGACAAGCACCGAAGAAGGCACCAGCAC CGAGCCGTCCGAAGGTTCCGCACCAGGTACAAGC GAGAGCGCGACTCCTGAATCTGGTCCGGGTAGCG AGCCTGCAACCAGCGGTTCTGAGACGCCGGGCAC TTCCGAATCTGCGACCCCGGAGTCCGGTCCAGGT TCAGAGCCGGCGACGAGCGGTTCGGAAACGCCGG GTACGTCTGAATCAGCCACGCCGGAGTCTGGTCC GGGTACCTCGACCGAACCAAGCGAAGGTTCGGCA CCGGGTACTAGCGAGAGCGCAACCCCTGAAAGCG GTCCGGGCAGCCCGGCAGGTTCTCCAACCAGCAC CGAAGAAGGTTCCCCTGCTGGTAGCCCGACCTCT ACGGAGGAAGGTAGCCCTGCAGGTTCCCCAACTT CTACTGAGGAAGGTACTTCTGAGTCCGCTACCCC AGAAAGCGGTCCTGGTACCTCCACTGAACCGTCT GAAGGCTCTGCACCAGGCACTTCTGAGTCTGCTA CTCCAGAAAGCGGCCCAGGTTCTGAACCAGCAAC TTCTGGCTCTGAGACTCCAGGCACTTCTGAGTCC GCAACGCCTGAATCCGGTCCTGGTTCTGAACCAG CTACTTCCGGCAGCGAAACCCCAGGTACCTCTGA GTCTGCGACTCCAGAGTCTGGTCCTGGTACTTCC ACTGAGCCTAGCGAGGGTTCCGCACCAGGTTCTC CGGCTGGTAGCCCGACCAGCACGGAGGAGGGTAC GTCTGAATCTGCAACGCCGGAATCGGGCCCAGGT TCGGAGCCTGCAACGTCTGGCAGCGAAACCCCGG GTACCTCCGAATCTGCTACACCGGAAAGCGGTCC TGGCAGCCCTGCTGGTTCTCCAACCTCTACCGAG GAGGGTTCACCGGCAGGTAGCCCGACTAGCACTG AAGAAGGTACTAGCACGGAGCCGAGCGAGGGTTA TGCTCCGGGTACGAGCGAGAGCGCAACGCCAGAG AGCGGTCCAGGCACCAGCGAATCGGCCACCCCTG AGAGCGGCCCAGGTACTTCTGAGAGCGCCACTCC TGAATCCGGCCCTGGTAGCGAGCCGGCAACCTCC GGCTCAGAAACTCCTGGTTCGGAACCAGCGACCA GCGGTTCTGAAACTCCGGGTAGCCCGGCAGGCAG CCCAACGAGCACCGAAGAGGGTACCAGCACGGAA CCGAGCGAGGGTTCTGCCCCGGGTACTTCCACCG AACCATCGGAGGGCTCTGCACCTGGTAGCGAACC TGCGACGTCTGGTTCTGAAACGCCGGGTACCAGC GAAAGCGCTACCCCAGAATCCGGTCCGGGCACTA GCACCGAGCCATCGGAGGGCTCCGCACCActgtC AggtCGTtctGATaacCATtccCCActgGGTctg GCTGGGTCTGGCACCGCCGAAGCAGCTagcgcct ctGGCGAGGTTCAGTTGTTGGAAAGCGGGGGCGG GCTTGTCCAACCTGGAGGTTCATTAAAATTGAGC TGTGCAGCCTCCCGGATTCACCTTTAACACGTATG CAATGAACTGGGTCCGTCAAGCGCCCGGTAAGGG GCTGGAGTGGGTAGCTCGCATCCGCTCGAAGTAT AATAATTACGCAACCTACTACGCAGACAGTGTCA AAGATCGCTTCACTATCTCACGCGACGACAGTAA GAACACGGCCTACTTACAGATGAACAATCTTAAA ACGGAGGACACCGCTGTCTACTACTGCGTGCGCC ACGGGAATTTCGGTAACTCTTATGTAAGTTGGTT CGCATATTGGGGACAAGGTACGTTGGTAACCGTA TCCAGCggtgcgaccccgccggaaaccggtgcgg aaaccgaaagcccgggtgaaaccaccggtggcag cgcggagagcgaaccgccgggtgaaggtGAACTG GTCGTCACGCAGGAGCCGTCCCTTACCGTTTCAC CAGGTGGAACAGTGACTCTGACGTGTCGCTCCTC CACTGGGCGGTTACAACTTCCAATTATGCTAAT TGGGTCCAGCAGAAGCCGGGCCAAGCCCCTCGCG GGTTGATTGGCGGCACCAACAAACGTGCTCCAGG GACACCTGCCCGTTTTTCGGGCTCCTTATTGGGG | |

TABLE 7-continued

T-cell binding compositions

| Construct Name | Amino Acid Sequence | SEQ ID NO: | DNA Sequence | SEQ ID NO: |
|---|---|---|---|---|
| | | | GGCAAAGCTGCACTGACGTTGTCTGGAGTTCAGC CGGAGGATGAGGCAGAGTATTACTGCGCATTGTG GTATTCTAATTTATGGGTTTTTGGAGGCGGCACA AAGCTGACCGTCCTG | |
| TBP-16 | HHHHHHGGSPAGS PTSTEEGTSESAT PESGPGTSTEPSE GSAPGSPAGSPTS TEEGTSTEPSEGS APGTSTEPSEGSA PGTSESATPESGP GSEPATSGSETPG SEPATSGSETPGS PAGSPTSTEEGTS ESATPESGPGTST EPSEGSAPGTSTE PSEGSAPGSPAGS PTSTEEGTSTEPS EGSAPGTSTEPSE GSAPGTSESATPE SGPGTSTEPSEGS APGTSESATPESG PGSEPATSGSETP GTSTEPSEGSAPG TSTEPSEGSAPGT SESATPESGPGTS ESATPESGPGSPA GSPTSTEEGTSES ATPESGPGSEPAT SGSETPGTSESAT PESGPGTSTEPSE GSAPGTSTEPSEG SAPGTSTEPSEGS APGTSTEPSEGSA PGTSTEPSEGSAP GTSTEPSEGSAPG SPAGSPTSTEEGT STEPSEGSAPGTS ESATPESGPGSEP ATSGSETPGTSES ATPESGPGSEPAT SGSETPGTSESAT PESGPGTSTEPSE GSAPGTSESATPE SGPGSPAGSPTST EEGSPAGSPTSTE EGSPAGSPTSTEE GTSESATPESGPG TSTEPSEGSAPGT SESATPESGPGSE PATSGSETPGTSE SATPESGPGSEPA TSGSETPGTSESA TPESGPGTSTEPS EGSAPGSPAGSPT STEEGTSESATPE SGPGSEPATSGSE TPGTSESATPESG PGSPAGSPTSTEE GSPAGSPTSTEEG TSTEPSEGSAPGT SESATPESGPGTS ESATPESGPGTSE SATPESGPGSEPA TSGSETPGSEPAT SGSETPGSPAGSP TSTEEGTSTEPSE GSAPGTSTEPSEG SAPGSEPATSGSE TPGTSESATPESG PGTSTEPSEGSAP LSGRSDNHVPLSL KMGGTAEAASASG | 445 | CATCACCACCATCATCACggAGGTAGCCCAGCTG GTAGCCCAACCTCTACCGAAGAAGGTACCTCTGA ATCCGCTACTCCAGAATCCGGTCCTGGTACTAGC ACTGAGCCAAGCGAAGGTTCTGCTCCAGGCTCCC CGGCAGGTAGCCCTACCTCTACCGAAGAGGGCAC TAGCACCGAACCATCTGAGGGTTCCGCTCCTGGC ACCTCCACTGAACCGTCCGAAGGCAGTGCTCCGG GTACTTCCGAAAGCGCAACTCCGGAATCCGGCCC TGGTTCTGAGCCTGCTACTTCCGGCTCTGAAACT CCAGGTAGCGAGCCAGCGACTTCTGGTTCTGAAA CTCCAGGTTCACCGGCGGGTAGCCCGACGAGCAC GGAGGAAGGTACCTCTGAGTCGGCCACTCCTGAG TCCGGTCCGGGCACGAGCACCGAGCCGAGCGAGG GTTCAGCCCCGGGTACCAGCACGGAGCCGTCCGA GGGTAGCGCACCGGGTTCTCCGGCGGGCTCCCCT ACGTCTACGGAAGAGGGTACGTCCACTGAACCTA GCGAGGGCAGCGCGCCAGGCACCAGCACTGAACC GAGCGAAGGCAGCGCACCTGGCACTAGCGAGTCT GCGACTCCGGAGAGCGGTCCGGGTACGAGCACGG AACCAAGCGAAGGCAGCGCCCCAGGTACCTCTGA ATCTGCTACCCCAGAATCTGGCCCGGGTTCCGAG CCAGCTACCTCTGGTTCGAAACCCAGGTACTT CCACTGAACCAAGCGAAGGTAGCGCTCCTGGCAC TTCTACTGAACCATCCGAAGGTTCCGCTCCTGGT ACGTCTGAAAGCGCTACCCCTGAAAGCGGCCCAG GCACCTCTGAAAGCGCTACTCCTGAGAGCGGTCC AGGCTCTCCAGCAGGTTCTCCAACCTCCACTGAA GAAGGCACCTCTGAGTCTGCTACCCCTGAATCTG GTCCTGGCTCCGAACCTGCTACCTCTGGTTCCGA AACTCCAGGTACCTCGGAATCTGCGACTCCGGAA TCTGGCCCGGGCACGAGCACGGAGCCGTCTGAGG GTAGCGCACCAGGTACCAGCACTGAGCCTTCTGA GGGCTCTGCACCGGGTACCTCCACGGAACCTTCG GAAGGTTCTGCGCCGGGTACCTCCACTGAGCCAT CCGAGGGTTCAGCACCAGGTACTAGCACGGAACC GTCCGAGGGCTCTGCACCAGGTACGAGCACCGAA CCGTCGGAGGGTAGCGCTCCAGGTAGCCCAGCGG GCTCTCCGACAAGCACCGAAGAAGGCACCAGCAC CGAGCCGTCCGAAGGTTCCGCACCAGGTACAAGC GAGAGCGCGACTCCTGAATCTGGTCCGGGTAGCG AGCCTGCAACCAGCGGTTCTGAGACGCCGGGCAC TTCCGAATCTGCGACCCCGGAGTCCGGTCCAGGT TCAGAGCCGGCGACGAGCGGTTCGGAAACGCCGG GTACGTCTGAATCAGCCACGCCGGAGTCTGGTCC GGGTACCTCGACCGAACCAAGCGAAGGTTCGGCA CCGGGTACTAGCGAGAGCGCAACCCCTGAAAGCG GTCCGGGCAGCCCGGCAGGTTCTCCAACCAGCAC CGAAGAAGGTTCCCCTGCTGGTAGCCCGACCTCT ACGGAGGAAGGTAGCCCTGCAGGTTCCCCAACTT CTACTGAGGAAGGTACTTCTGAGTCCGCTACCCC AGAAAGCGGTCCTGGTACCTCCACTGAACCGTCT GAAGGCTCTGCACCAGGCACTTCTGAGTCTGCTA CTCCAGAAAGCGGCCCAGGTTCTGAACCAGCAAC TTCTGGCTCTGAGACTCCAGGCACTTCTGAGTCC GCAACGCCTGAATCCGGTCCTGGTTCTGAACCAG CTACTTCGGCAGCGAAACCCCAGGTCTCTGA GTCTGCGACTCCAGAGTCTGGTCCTGGTACTTCC ACTGAGCCTAGCGAGGGTTCCGCACCAGGTTCTC CGGCTGGTAGCCCGACCAGCACGGAGGAGGGTAC GTCTGAATCTGCAACGCCGGAATCGGGCCCAGGT TCGGAGCCTGCAACGTCTGGCAGCGAAACCCCGG GTACCTCCGAATCTGCTACACCGGAAAGCGGTCC TGGCAGCCCTGCTGGTTCTCCAACCTCTACCGAG GAGGGTTCACCGGCAGGTAGCCCGACTAGCGAGG AAGAAGGTACTAGCACGGAGCCGAGCGAGGGTAG TGCTCCGGGTACGAGCGAGAGCGCAACGCCAGAG AGCGGTCCAGGCACCAGCGAATCGGCCACCCCTG AGAGCGGCCCAGGTACTTCTGAGAGCGCCACTCC TGAATCCGGCCCTGGTAGCGAGCCGGCAACCTCC | 461 |

TABLE 7-continued

T-cell binding compositions

| Construct Name | Amino Acid Sequence | SEQ ID NO: | DNA Sequence | SEQ ID NO: |
|---|---|---|---|---|
| | EVQLLESGGGLVQ PGGSLKLSCAASG FTFNTYAMNWVRQ APGKGLEWVARIR SKYNNYATYYADS VKDRFTISRDDSK NTAYLQMNNLKTE DTAVYYCVRHGNF GNSYVSWFAYWGQ GTLVTVSSGATPP ETGAETESPGETT GGSAESEPPGEGE LVVTQEPSLTVSP GGTVTLTCRSSTG AVTTSNYANWVQQ KPGQAPRGLIGGT NKRAPGTPARFSG SLLGGKAALTLSG VQPEDEAEYYCAL WYSNLWVFGGGTK LTVL | | GGCTCAGAAACTCCTGGTTCGGAACCAGCGACCA GCGGTTCTGAAACTCCGGGTAGCCCGGCAGGCAG CCCAACGAGCACCGAAGAGGGTACCAGCACGGAA CCGAGCGAGGGTTCTGCCCCGGGTACTTCCACCG AACCATCGGAGGGCTCTGCACCTGGTAGCGAACC TGCGACGTCTGGTTCTGAAACGCCGGGTACCAGC GAAAGCGCTACCCCAGAATCCGGTCCGGGCACTA GCACCGAGCCATCGGAGGGCTCCGCACCActgTC AggtCGTctGATaacCATgttCCActgTCTctg AAAatgGGTGGCACCGCCGAAGCAGCTagcgcct ctGGCGAGGTTCAGTTGTTGGAAAGCGGGGGCGG GCTTGTCCAACCTGGAGGTTCATTAAAATTGAGC TGTGCAGCCTCCGGATTCACCTTTAACACGTATG CAATGAACTGGGTCCGTCAAGCGCCCGGTAAGGG GCTGGAGTGGGTAGCTCGCATCCGCTCGAAGTAT AATAATTACGCAACCTACTACGCAGACAGTGTCA AAGATCGCTTCACTATCTCACGCGACGACAGTAA GAACACGGCCTACTTACAGATGAACAATCTTAAA ACGGAGGACACCGCTGTCTACTACTGCGTGCGCC ACGGGAATTTCGGTAACTCTTATGTAAGTTGGTT CGCATATTGGGGACAAGGTACGTTGGTAACCGTA TCCAGCggtgcgaccccgccggaaaccggtgcgg aaaccgaaagcccgggtgaaaccaccggtggcag cgcggagagcgaaccgccgggtgaaggtGAACTG GTCGTCACGCAGGAGCCGTCCCTTACCGTTTCAC CAGGTGGAACAGTGACTCTGACGTGTCGCTCCTC CACTGGGGCGGTTACAACTTCCAATTATGCTAAT TGGGTCCAGCAGAAGCCGGGCCAAGCCCCTCGCG GGTTGATTGGCGGCACCAACAAACGTGCTCCAGG GACACCTGCCCGTTTTTCGGGCTCCTTATTGGGG GGCAAAGCTGCACTGACGTTGTCTGGAGTTCAGC CGGAGGATGAGGCAGAGTATTACTGCGCATTGTG GTATTCTAATTTATGGGTTTTTGGAGGCGGCACA AAGCTGACCGTCCTG | |

5. Flexible Linkers

In another aspect, the present invention provides flexible linkers to join the respective binding domains of the subject compositions. In some embodiments, the invention provides chimeric polypeptide assembly compositions comprising a first scFv and a second scFv in which the VL and VH of each scFv are linked together by a long linker of hydrophilic amino acids selected from the sequences set forth in Table 8 and the scFv are linked together by a short linker of hydrophilic amino acids selected from the group of sequences set forth in Table 9. In one embodiment, the long linker used to link the VL and VH is L7 of Table 8 and the intermolecular linker that links the two scFv is S-1 of Table 9. In another embodiment, the invention provides chimeric polypeptide assembly compositions comprising a single chain diabody in which after folding, the first domain (VL or VH) is paired with the last domain (VH or VL) to form one scFv and the two domains in the middle are paired to form the other scFv in which the first and second domains, as well as the third and last domains, are linked together by a short linker of hydrophilic amino acids selected from the sequences set forth in Table 9 and the second and the third variable domains are linked by a long linker selected from Table 8. As will be appreciated by one of skill in the art, the selection of the short linker and long linker is to prevent the incorrect pairing of adjacent variable domains, thereby facilitating the formation of the diabody configuration.

TABLE 8

Intramolecular Long Linkers

| Linker # | Name | Amino Acid Sequence | SEQ ID NO: |
|---|---|---|---|
| L1 | (G4S)3 | GGGGSGGGGSGGGGS | 462 |
| L2 | MT110_18 | GEGTSTGSGGSGGSGGAD | 463 |
| L3 | MT103_18 | VEGGSGGSGGSGGSGGVD | 464 |
| L4 | UCHT1_29 | RTSGPGDGGKGGPGKGPGGEGTKGTGPGG | 465 |
| L5 | Y30 | GSEGSEGEGGGEGSEGEGSGEGGEGEGSG | 466 |
| L6 | Y32 | TGSGEGSEGEGGGEGSEGEGSGEGGEGEGSGT | 467 |

TABLE 8-continued

Intramolecular Long Linkers

| Linker # | Name | Amino Acid Sequence | SEQ ID NO: |
|---|---|---|---|
| L7 | G1_30_3 | GATPPETGAETESPGETTGGSAESEPPGEG | 468 |
| L8 | G9_30_1 | GSAAPTAGTTPSASPAPPTGGSSAAGSPST | 469 |
| L9 | Y30_modified | GEGGESGGSEGEGSGEGEGGSGGEGESEGG | 470 |
| L10 | G1_30_1 | STETSPSTPTESPEAGSGSGSPESPSGTEA | 471 |
| L11 | G1_30_2 | PTGTTGEPSGEGSEPEGSAPTSSTSEATPS | 472 |
| L12 | G1_30_4 | SESESEGEAPTGPGASTTPEPSESPTPETS | 473 |
| L13 | UCHT1_modified | PEGGESGEGTGPGTGGEPEGEGGPGGEGGT | 474 |

TABLE 9

Intermolecular Short Linkers

| Name | Amino Acid Sequence | SEQ ID NO: |
|---|---|---|
| S-1 | SGGGGS | 475 |
| S-2 | GGGGS | 476 |
| S-3 | GGS | |
| S-4 | GSP | |

6. Chimeric Polypeptide Assembly Configurations

It is an object of the invention to provide chimeric polypeptide assembly compositions that are designed and created in prodrug form in order to confer certain structural, activity, pharmaceutical and pharmacologic properties. The design of the subject compositions was driven by at least three important properties; 1) providing compositions having bispecific binding domains with the capability to concurrently bind an effector cell to a target cell with the resultant formation of an immunological synapse; 2) providing compositions with a bulking moiety that i) shields the binding domains and reduces binding affinity for the target antigens when the composition is in an intact prodrug form, ii) provides enhanced half-life when administered to a subject, iii) reduces extravasation in normal tissues and organs compared to diseased tissues (e.g., tumor), and iv) has an increased safety profile compared to conventional bispecific cytotoxic antibody therapeutics; and 3) is capable of being activated when cleaved by one or more mammalian proteases when in proximity of diseased tissues, thereby releasing the bispecific binding domain such that it regains its full binding affinity potential for the target antigens. The design of the subject compositions takes advantage of the properties of XTEN and the peptidic release segment (RS) components, and their positioning relative to the first portion bispecific binding domains achieves the foregoing properties.

Without being bound to a particular theory, it is believed that using the bispecific binding domain format as described above, the released binding domains are capable of killing target cells by recruitment of cytotoxic effector cells without any need for pre- and/or co-stimulation. Further, the independence from pre- and/or co-stimulation of the effector cell may substantially contribute to the exceptionally high cytotoxicity mediated by the released binding domains. In some embodiments, the released second binding domain is designed with binding specificities such that it has the capability to target cytotoxic effector cells (e.g., T cells, NK cells, cytokine induced killer cell (CIK cell)), to preselected surface antigens on tumor cells in a subject while the first binding domain is designed with binding specificities to tumor marker antigens associated with tumor cells, thereby effecting an immunological synapse and a selective, directed, and localized effect of released cytokines and effector molecules against the target tumor, with the result that tumor cells are damaged or destroyed, resulting in antitumor activity and therapeutic benefit to a subject. In one embodiment, the released second binding domain binds to an effector cell antigen that is capable of modulating one or more functions of an effector cell, resulting in or contributed to the cytolytic effect on the target tumor cell. The effector cell antigen can by expressed by the effector cell or other cells. In some embodiments, the effector cell antigen is expressed on cell surface of the effector cell. Non-limiting examples are CD3, CD4, CD8, CD25, CD38, CD69, CD45RO, CD57, CD95, CD107, and CD154. In other embodiments, the effector cell antigen is a Th1 cytokine selected from IL2, IL10, IL12, IFNγ, and TNFα. Thus, it will be understood by one of skill in the art that the configurations of the subject compositions are intended to selectively or disproportionately deliver the active form of the composition to the target tumor tissue or cancer cell, compared to healthy tissue or healthy cells in a subject in which the composition is administered, with resultant therapeutic benefit. As is evident from the foregoing, the invention provides a large family of polypeptides in designed configurations to effect the desired properties.

In the case of XTEN as a bulking moiety, several unique and beneficial physicochemical and pharmacologic properties are conferred to the subject compositions that are XTENylated. Non-limiting examples of the enhanced properties of the subject compositions include increases in the overall solubility and metabolic stability, reduced susceptibility to proteolysis in circulation, reduced immunogenicity, reduced rate of absorption when administered subcutaneously or intramuscularly, reduced clearance by the kidney, reduced toxicity, the shielding effect of XTEN on the first portion binding moieties until released by cleavage of the RS, and enhanced pharmacokinetic properties. In particular, it is specifically contemplated that the subject compositions are designed such that they have an enhanced therapeutic index and reduced toxicity or side effects, achieved by a combination of the shielding effect and steric hindrance of XTEN on binding affinity over the first portion binding domains in the prodrug form, yet are able to release the bispecific binding domains (achieved by inclusion of a peptidyl cleavage sequence in the RS composition) in proximity to or within a target tissue (e.g., a tumor) that produces a protease for which the RS is a substrate.

In one aspect, XTEN are used as a carrier in the compositions, the invention taking advantage of the discovery that increasing the length of the non-repetitive, unstructured polypeptides enhances the unstructured nature of the XTENs and correspondingly enhances the physicochemical and pharmacokinetic properties of compositions comprising the XTEN carrier. In general, XTEN with cumulative lengths longer that about 400 residues incorporated into the composition results in longer half-life compared to shorter cumulative lengths, e.g., shorter than about 290 residues. Not to be bound by a particular theory, the XTEN can adopt open conformations due to the electrostatic repulsion between individual charges of incorporated charged residues in the XTEN as well as because of the inherent flexibility imparted by the particular hydrophilic amino acids in the sequence that lack potential to confer secondary structure. The result is that the subject XTEN are useful, in part, because they impart a high hydrodynamic radius to the resulting composition; a property that confers a corresponding increased apparent molecular weight to the XTENylated composition compared to the composition without the XTEN. The XTENylation results in compositions that have increased hydrodynamic radii, increased apparent molecular weight, and increased apparent molecular weight factor compared to a protein not linked to an XTEN. For example, the XTEN can effectively enlarge the hydrodynamic radius of the composition beyond the glomerular pore size of approximately 3-5 nm (corresponding to an apparent molecular weight of about 70 kDa) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins with a corresponding increase in terminal half-life. The increased hydrodynamic radius imparted by XTEN also reduces the extravasation of intact prodrug form of the chimeric polypeptide assembly compositions from the circulatory system in areas of normal, healthy tissue with average pore sizes of 5-12 nm, but permits the exit of the intact composition molecules in blood vessels that permeate tumors, where the epithelial cell junctions are more porous. It is long been known that various functions of tumor vasculature are impaired, such as a higher vascular permeability than normal vessels (Duran-Reynals, F. Studies on the localization of dyes and foreign proteins in normal and malignant tissue. Am J Cancer 35:98-107 (1939); Babson A L, Winnick T. Protein transfer in tumor-bearing rats. Cancer Res14:606-611 (1954)). These impaired functions contributed to the higher concentration of plasma proteins detected in tumor tissues than in normal tissues; a phenomenon was elucidated by Maeda and colleagues (Matsumura Y, Maeda H. A new concept for macromolecular therapeutics in cancer chemotherapy: mechanism of tumoritropic accumulation of proteins and the antitumor agent smancs. Cancer Res 46:6387-6392 (1986); Maeda H, Matsumura Y. Tumoritropic and lymphotropic principles of macromolecular drugs. Crit Rev Ther Drug Carrier Syst 6:193-210 (1989), who described it as the enhanced permeability and retention effect, resultings from a combination of the increased permeability of tumor blood vessels and the decreased rate of clearance of functional lymphatic vessels in the tumor, with the net result that macromolecules accumulate in tumors. It is generally known that the physiologic upper limit of pore size in the capillary walls of most non-sinusoidal blood capillaries to the passage of non-endogenous macromolecules ranges between 5 and 12 nm (Hemant Sarin. Physiologic upper limits of pore size of different blood capillary types and another perspective on the dual pore theory of microvascular permeability. J Angiogenes Res. 2010; 2:14), while inter-endothelial cell gaps in the blood-tumor barrier of both brain tumors and peripheral tumors have been reported to range between 40 nm and 200 nm or greater in diameter (Sarin, H. et al. Physiologic upper limit of pore size in the blood-tumor barrier of malignant solid tumors. J. Translational Medicine 2009 7:51). In an object of the invention, the subject chimeric polypeptide assembly compositions were designed to take advantage of this differential in pore size by the addition of the bulking moiety, e.g., XTEN, such that extravasation of the intact chimeric polypeptide assembly in normal tissue is reduced, but in the leaky environment of the tumor vasculature or other areas of inflammation, the intact assembly can extravasate and be activated by the proteases in the tumor environment, releasing the first portion comprising the binding domains to the effector and target cells. In the case of the RS of the chimeric polypeptide assembly, the design takes advantage of the circumstance that when a chimeric polypeptide assembly is in proximity to diseased tissues; e.g., a tumor, that elaborates one or more proteases, the RS seqeuences that are susceptible to the one or more proteases expressed by the tumor are capable of being cleaved by the proteases (described more fully, above). The action of the protease cleaves the release segment (RS) of the composition, releasing the first portion binding domains from the composition, decreasing the molecular weight and hydrodynamic radius of the released first portion bispecific binding domains. As will be appreciated, the decrease in molecular weight and hydrodynamic radius of the composition also confers the property that the released first portion bispecific binding domains are able to more freely move in solution, move through smaller pore spaces in tissue and tumors, and extraysate more readily from the larger pores of the tumor vasculature into the tumor, resulting in the attachment and linkage of the effector cell and the tumor cell. Such property can be measured by different assays. In one embodiment, wherein the RS of the chimeric polypeptide assembly is cleaved by a mammalian protease, upon cleavage and release of the first portion bispecific binding domains and the third portion from said composition, said first portion has a diffusion coefficient in phosphate buffered saline that is at least 2-fold, 3-fold, 4-fold, 5-fold, 6-fold, 7-fold, 8-fold, 9-fold, 10-fold, 20-fold, 50-fold, or 100-fold greater compared to the intact chimeric polypeptide assembly composition. In another embodiment, the apparent molecular weight of the intact composition is at least 2-fold, at least 3-fold, at least 4-fold, or at least 5-fold, or at least 10-fold greater than the first portion released by cleavage of the RS by a mammalian protease, when the apparent molecular weight is determined by size exclusion chromatography (SEC). In another embodiment, the hydrodynamic radius of the intact chimeric polypeptide assembly composition is at least 2-fold, or at least 3-fold, or at least 4-fold, or at least 5-fold, or at least 10-fold greater than the first portion released by cleavage of the RS by a mammalian protease, when the hydrodynamic radius is determined by size exclusion chromatography (SEC). In another embodiment, the invention provides a chimeric polypeptide assembly, wherein upon cleavage of the second portion to release said first portion and said third portion from said chimeric polypeptide assembly, the hydrodynamic radius of the released first portion is less than about 30%, or less than about 40%, or less than about 50% of the hydrodynamic radius of the intact chimeric polypeptide assembly, when hydrodynamic radius is assessed by size exclusion chromatography. In another embodiment, the invention provides a chimeric polypeptide assembly, wherein upon cleavage of the second portion to release said first portion and said third portion from said chimeric polypeptide assembly, the hydrodynamic radius of the released first portion is less than about 5 nm, or less than about 4 nm, or less than about 3 nm when hydrodynamic radius is determined by size exclusion chromatography. In another embodiment, the invention provides a chimeric polypeptide assembly, wherein the released first portion having a hydrodynamic radius of less than about 5 nm, or less than about 4 nm, or less than about 3 nm, when hydrodynamic radius is determined by size exclusion chromatography, has greater ability to penetrate a tumor tissue compared to an intact chimeric polypeptide assembly. In another embodiment, the invention provides a chimeric polypeptide assembly, wherein the hydrodynamic radius of the intact chimeric polypeptide assembly is greater than about 8 nm, or greater than about 9 nm, or greater than about 10 nm when hydrodynamic radius is determined by size exclusion chromatography, and wherein the intact chimeric polypeptide assembly is less able to extravasate from vasculature of normal tissue of a subject compared to vasculature of a tumor tissue.

It is contemplated that the subject compositions will, by their design and linkage to XTEN, have enhanced pharmacokinetic properties when administer to a subject compared to the corresponding first portion binding domains not linked to XTEN. In one embodiment, a chimeric polypeptide assembly composition exhibits a terminal half-life in a subject that is increased, upon or following administration to a subject, in comparison to the corresponding first portion not linked to the composition, by at least about 2-fold, 3-fold, 4-fold, 5-fold, 6-fold, 7-fold, 8-fold, 9-fold, 10-fold, 20-fold, 30-fold, 40-fold, or 100-fold greater. In another embodiment, a chimeric polypeptide assembly composition exhibits increased area under the curve (AUC), upon or following administration to a subject, in comparison to the corresponding first portion not linked to the composition, of at least 25%, 50%, 100%, 200%, or at least 300% or more. In another embodiment, a chimeric polypeptide assembly composition exhibits a lower volume of distribution, upon or following administration to a subject, in comparison to the corresponding first portion not linked to the composition, of at least 25% lower, or 50%, or 100%, or 200%, or at least 300% lower. In one embodiment, a chimeric polypeptide assembly composition exhibits a terminal half-life of at least about 20 h, or at least about 30 h, or at least about 32 h, or at least about 48 h, or at least about 72 h, or at least about 96 h, or at least about 120 h, or at least about 144 h, or at least about 7 days, or at least about 10 days, or at least about 14 days following administration to a subject. In another aspect, it is specifically contemplated that because of the design of the subject chimeric polypeptide assembly compositions that are preferentially activated by protease(s) in association with a diseased tissue such as, but not limited to, a tumor, the concentration of the released first portion in the circulation of a subject will be low, thereby contributing to the improved safety profile and lower incidence of side effects compared to bispecific compositions not having the protective bulking moiety and release segment. In one embodiment, the invention provides a chimeric polypeptide assembly, wherein the plasma Cmax concentration of the released first portion upon or following a single administration of the chimeric polypeptide composition to a subject does not exceed about 0.01 ng/ml, or about 0.03 ng/ml, or about 0.1 ng/ml, or about 0.3 ng/ml, or about 1 ng/ml, or about 10 ng/ml, or about 100 ng/ml. In another embodiment, the invention provides a chimeric polypeptide assembly, wherein the plasma Cmax concentration of the released first portion upon or following a single administration of the chimeric polypeptide composition to a subject is a least 3-fold lower, or at least 10-fold lower, or at least 30-fold lower, or at least 100-fold lower than the plasma levels of the intact chimeric polypeptide assembly in the same subject. In the foregoing embodiments of the paragraph, the subject is a mouse, or a rat, or a dog, or a monkey, or a human.

In another embodiment, a chimeric polypeptide assembly composition exhibits slower absorption after subcutaneous or intramuscular injection in a subject, in comparison to the corresponding first portion not linked to the composition, such that the Cmax is at least 25%, 50%, 100%, 200%, or at least 300% lower, which, in turn, results in reductions in adverse effects of the chimeric polypeptide assembly compositions that, collectively, results in an increased period of time that a conjugation composition administered to a subject provides or retains therapeutic activity.

In another aspect, it is specifically contemplated that the XTEN of the subject chimeric polypeptide chimeric polypeptide assembly compositions provides both steric hindrance and a shielding effect for the binding domains of the first portion of the compositions such that both the effector cell binding component and the target cell binding component of the intact prodrug form have a reduced ability to interact with their respective ligands, but that upon cleavage of the RS by a protease and release of the XTEN and the conversion of the prodrug form of the assembly to the activated form, the optimal binding capacity of the released bispecific binding components is restored. Thus, the XTEN of the intact chimeric polypeptide assembly composition inhibits the binding of the binding domains to the tumor-specific marker or an antigen of a target cell antigen (e.g., EpCAM or HER2) and/or the effector cell antigen (e.g., CD3 T-cell antigen) compared to the binding domains released by the cleavage of the RS by the protease. Conversely, the binding domains of the released first portion from the composition by the action of the protease have a higher binding affinity for their respective ligands compared to the binding domains of the intact chimeric polypeptide assembly composition. It is an object of the invention that the binding affinity of each binding domain of the released first portion from the chimeric polypeptide assembly composition is greater for the respective target ligands compared to the binding domains of the intact composition, such as when assayed in an in vitro binding assay as described herein. In one embodiment, the binding affinity of the effector cell binding domain released from the composition by cleavage of the RS by a protease is at least 2-fold, or at least 3-fold, or at least 4-fold, or at least 5-fold, or at least 6-fold, or at least 7-fold, or at least 8-fold, or at least 9-fold, or at least 10-fold, or at least 20-fold greater for the effector cell antigen compared to the effector cell binding domain of the intact chimeric polypeptide assembly composition, as measured in an in vitro cell assay with an effector cell having said effector cell antigen on the cell surface of said cell or in an ELISA with bound effector cell antigen. In one embodiment, the effector cell antigen is CD3. In other embodiments, the binding affinity of the tumor cell binding domain released from the composition by cleavage of the RS by a protease is at least 2-fold, or at least 3-fold, or at least 4-fold, or at least 5-fold, or at least 6-fold, or at least 7-fold, or at least 8-fold, or at least 9-fold, or at least 10-fold, or at least 20-fold greater for the tumor-specific marker or target cell antigen compared to the tumor cell binding domain of the intact chimeric polypeptide assembly composition, as measured in an in vitro cell assay with an tumor cell having said antigen on the cell surface of said cell or in an ELISA with bound effector cell antigen. In one embodiment of the foregoing, the tumor-specific marker or an antigen of a target cell is selected from the group consisting of alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. It is specifically contemplated in the embodiments of the paragraph that the shielding effect of the XTEN applies to both binding domains of the foregoing embodiments of the intact, prodrug form of the chimeric polypeptide assembly, and that upon release of the XTEN from the chimeric polypeptide assembly composition by cleavage of the RS, the full binding capacity of the respective binding domains is restored.

It is an object of the invention that the addition of the bulking moiety to the composition results in a shielding effect in the intact chimeric polypeptide assembly composition and the concomitant reduction in binding to T cells and target tissues results in reduced production of Th1 T-cell associated cytokines or other proinflammatory mediators during systemic exposure when administered to a subject such that the overall side-effect and safety profile is improved compared to bispecific binding compositions not linked to a binding moiety such as XTEN. As an important component of cellular immunity, the production of IL-2, TNF-alpha, and IFN-gamma are hallmarks of a Th1 response (Romagnani S. T-cell subsets (Th1 versus Th2). Ann Allergy Asthma Immunol. 2000. 85(1):9-18), particularly in T cells stimulated by anti-CD3 (Yoon, S. H. Selective addition of CXCR3+CCR4-CD4+Th1 cells enhances generation of cytotoxic T cells by dendritic cells in vitro. Exp Mol Med. 2009. 41(3):161-170), and Il-4, IL-6, and IL-10 are also proinflammatory cytokines important in a cytotoxic response for bispecific antibody composition (Zimmerman, Z., et al. Unleashing the clinical power of T cells: CD19/CD3 bispecific T cell engager (BiTE®) antibody composition blinatumomab as a potential therapy. Int. Immunol. (2015) 27(1): 31-37). In some embodiments, an intact, uncleaved chimeric polypeptide assembly composition exhibits at least 2-fold, or at least 3-fold, or at least 4-fold, or at least 5-fold, or at least 6-fold, or at least 7-fold, or at least 8-fold, or at least 9-fold, or at least 10-fold, or at least 20-fold, or at least 30-fold, or at least 50-fold, or at least 100-fold, or at least 1000-fold reduced potential to result in the production of Th1 and/or proinflammatory cytokines when said assembly is in contact with the effector cell and a target cell in an in vitro cell-based cytokine stimulation assay (such as described in the Examples, below) compared to the cytokine levels stimulated by the corresponding released first portion binding domains of a protease-treated chimeric polypeptide assembly composition in the in vitro cell-based stimulation cytokine assay, wherein the cytokines are selected from the group consisting of IL-2, IL-4, IL-6, IL-10, TNF-alpha and IFN-gamma. In one embodiment of the foregoing, the production of the Th1 cytokine is assayed in an in vitro assay comprising effector cells such as PBMC or CD3+ T cells and target cells having a tumor specific marker antigen selected from the group consisting of alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. In another embodiment of the foregoing, the cytokine is IL-2. In another embodiment of the foregoing, the cytokine is TNFalpha. In another embodiment of the foregoing, the cytokine is IFN-gamma. In another embodiment, an intact, uncleaved chimeric polypeptide assembly composition administered to a subject having a tumor with an antigen that can be bound by the binding domain of the released first portion of the assembly exhibits at least 2-fold, at least 3-fold, at least 4-fold, at least 5-fold, at least 6-fold, at least 7-fold, at least 8-fold, at least 9-fold, at least 10-fold, at least 20-fold, at least 30-fold, at least 50-fold, at least 100-fold, or at least 1000-fold reduced potential to result in the production of Th1 and/or proinflammatory cytokines in the subject compared to the cytokine levels produced by the corresponding released binding domains of a protease-treated chimeric polypeptide assembly composition in a comparable subject with a tumor. In the foregoing embodiment, the cytokines can be assessed from a blood, fluid, or tissue sample removed from the subject. In the foregoing embodiment, the subject can be mouse, rat, monkey, and human. In an advantage of the subject chimeric polypeptide assembly compositions, however, it has been discovered that the cytolytic properties of the compositions do not require prestimulation by cytokines; that formation of the immunological synapse of the effector cell bound to the target cell by the first portion binding domains is sufficient to effect cytolysis or apoptosis in the target cell. Nevertheless, the production of proinflammatory cytokines are useful markers to assess the potency or the effects of the subject chimeric polypeptide assembly compositions; whether by in vitro assay or in the monitoring of treatment of a subject with a tumor.

In accordance with the binding domain embodiments referred to above, it is advantageous if the binding site recognizing the tumor cell marker antigen has a high binding affinity in order to capture the target cells to be destroyed with high efficiency. The chimeric polypeptide assembly compositions of the invention have the advantage that they may be used a number of times for killing tumour cells since, in preferred embodiments, the target cell binding domain has an affinity with a $K_d$ value in the range of $10^{-7}$ to $10^{-10}$ M, as determined in an vitro binding assay. If the affinity of a bispecific binding domain for binding a target tumor antigen is too high, the composition binds the expressing tumour cell and remains on its surface, making it unable to release and bind to another cell. In one embodiment, the effector cell binding domain of a subject chimeric polypeptide assembly composition has a binding constant of between $10^{-5}$ and $10^{-7}$M, as determined in an vitro binding assay, detailed examples of which are described in the Examples, below. In another embodiment, the effector cell binding domain of a subject chimeric polypeptide assembly composition has a binding constant of between $10^{-5}$ and $10^{-10}$ M, as determined in an vitro binding assay.

In one aspect, it is a feature of the designed composition that when the RS of the chimeric polypeptide assembly is cleaved by a mammalian protease in the environment of the target cell and is converted from the prodrug form to the activated form, upon cleavage and release of the first portion bispecific binding domains and the third portion from said composition, said first portion concurrently binds to a T cell bearing the effector cell antigen, e.g., CD3, and to a tumor cell bearing the tumor-specific marker or an antigen of a target cell targeted by the first binding domain, whereupon the effector cell is activated. In some embodiments, wherein the assembly is activated by the cleavage of the RS, the subsequent concurrent binding of the effector cell and the target cell results in at least a 3-fold, or a 10-fold, or a 30-fold, or a 100-fold, or a 300-fold, or a 1000-fold activation of the effector cell, wherein the activation is assessed by the production of cytokines, cytolytic proteins, or lysis of the target cell, assessed in an in vitro cell-based assay. In another embodiment, the concurrent binding of a T cell bearing the human CD3 antigen and a tumor cell bearing the tumor-specific marker or an antigen of a target cell by the released first portion binding domains forms an immunologic synapse, wherein the binding results in the release of T cell-derived effector molecules capable of lysing the tumor cell. Non-limiting examples of the in vitro assay for measuring effector cell activation and/or cytolysis include cell membrane integrity assay, mixed cell culture assay, FACS based propidium Iodide assay, trypan Blue influx assay, photometric enzyme release assay, ELISA, radiometric 51Cr release assay, fluorometric Europium release assay, CalceinAM release assay, photometric MTT assay, XTT assay, WST-1 assay, alamarBlue assay, radiometric 3H-Thd incorporation assay, clonogenic assay measuring cell division activity, fluorometric Rhodamine123 assay measuring mitochondrial transmembrane gradient, apoptosis assay monitored by FACS-based phosphatidylserine exposure, ELISA-based TUNEL test assay, caspase activity assay, and cell morphology assay, or other assays known in the art for the assay of cytokines, cytolytic proteins, or lysis of cells, or the methods of the Examples, below.

It will be appreciated by one of skill in the art that in the context of treatment of a subject using the subject compositions, the chimeric polypeptide assembly are present in a prodrug form and are converted to a more active form when entering a certain cellular environment by the action of proteases colocalized with the cellular environment. Upon release from the composition by the action of the protease(s) in the target tissue, the second binding domain with binding specificity to an effector cell antigen and the first binding domain with binding specificity to a tumor-specific marker or an antigen of a target cell regain their full capability to concurrently bind to and link together the effector cell to the target cell, forming an immunological synapse. The formation of the immuological synapse causes the effector cell to become activated, with various signal pathways turning on new gene transcription and the release, by exocytosis, the effector molecule contents of its vesicles. Depending on the type of effector cell, different cytokines and lymphokines are released; e.g., Type 1 helper T cells (Th1) release cytokines like IFN-γ and TNF-0 while Type 2 helper T cells (Th2) release cytokines like IL-4, IL-5, IL-10, and IL-13 that stimulate B cells, and cytotoxic T Lymphocytes (CTLs) release cytotoxic molecules like perforin and granzymes that kill the target (collectively, "effector molecules"). It is specifically contemplated that upon the concurrent binding to and linking together the effector cell to the target tumor cell by the released bispecific binding domains of the first portion of the chimeric polypeptide assembly, at very low effector to target (E:T) ratios the tumor cell is acted upon by the effector molecules released by the effector cell into the immunological synapse between the cells, resulting in damage, perforin-mediated lysis, granzyme B-induced cell death and/or apoptosis of the tumor cell. Thus, in another aspect, it is a feature of the designed composition that when the chimeric polypeptide assembly is administered to a subject with a tumor, the prodrug form remains in the circulatory system in normal tissue but is able to extravasate in the more permeable vasculature of the tumor such that the prodrug form of the assembly is activated by the proteases co-localized with the tumor and that the released first portion second binding domain concurrently binds an effector cell (e.g., CD3 antigen of a T cell) and a tumor cell expressing the tumor-specific market targeted by the first binding domain of the composition, whereupon the effector cell is activated and lysis of the tumor cell is effected. In one embodiment of the foregoing, the released first portion in the tumor of the subject concurrently bound to a tumor cell and an effector cell exhibits an increased ability to activate effector cells of at least 10-fold, or at least 30-fold, or at least 100-fold, or at least 200-fold, or at least 300-fold, or at least 400-fold, or at least 500-fold, or at least 1000-fold compared to the corresponding intact chimeric polypeptide assembly composition. In another embodiment of the foregoing, the released first portion in the tumor of the subject concurrently bound to a tumor cell and an effector cell exhibits an increased ability to lyse the tumor cell of at least 10-fold, or at least 30-fold, or at least 100-fold, or at least 200-fold, or at least 300-fold, or at least 400-fold, or at least 500-fold, or at least 1000-fold compared to the corresponding intact chimeric polypeptide assembly composition. In the foregoing embodiments, the effector cell activation and/or the cytotoxicity is assayed by conventional methods known in the art, such as cytometric measurement of activated effector cells, assay of cytokines, measurement of tumor size, or by histopathology. In the foregoing embodiments, the subject can be mouse, rat, dog, monkey, and human.

As is evident from the foregoing, the invention provides a large family of polypeptides in designed configurations to effect the desired properties; specific formulae of which are provided herein. In one embodiment, the invention provides a chimeric polypeptide assembly composition with a first portion comprising the first binding domain and the second binding domain, a second portion comprising the release segment, and a third portion comprising the bulking moiety. In the embodiment, the invention provides a composition having the configuration of formula I (depicted N-terminus to C-terminus):

(first portion)-(second portion)-(third portion)    I wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease; and the third portion is a bulking moiety. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below. In one embodiment, the first portion VL and VH are selected from Tables 1 and 2; RS is selected from the group of sequences set forth in Table 4; and the bulking moiety is selected from the group consisting of: XTEN; albumin binding domain; albumin; IgG binding domain; polypeptides consisting of proline, serine, and alanine; fatty acid; Fc domain; polyethylene glycol (PEG), PLGA; and hydoxylethyl starch. Where desired, the bulking moiety is an XTEN having at least about 90%, 91%, 92%, 93%, 94%, 95%, 96%, 97%, 98%, 99%, or 100% sequence identity to a sequence selected from the group of sequences set forth in Table 5. In the foregoing embodiments, the composition is a recombinant fusion protein. In another embodiment, the portions are linked by chemical conjugation. A schematic of the composition configuration of formula I is presented in FIG. 6.

In another embodiment, the invention provides a composition having the configuration of formula II (depicted N-terminus to C-terminus):

(third portion)-(second portion)-(first portion)    II wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease; and the third portion is a bulking moiety. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below. In one embodiment, the first portion VL and VH are selected from Tables 1 and 2; RS is selected from the group of sequences set forth in Table 4; and the bulking moiety is selected from the group consisting of: XTEN; albumin binding domain; albumin; IgG binding domain; polypeptides consisting of proline, serine, and alanine; fatty acid; and Fc domain. Where desired, the bulking moiety is an XTEN having at least about 90%, 91%, 92%, 93%, 94%, 95%, 96%, 97%, 98%, 99%, or 100% sequence identity to a sequence selected from the group of sequences set forth in Table 5. In the foregoing embodiments, the composition is a recombinant fusion protein. In another embodiment, the portions are linked by chemical conjugation. A schematic of the composition configuration of formula I is presented in FIG. 6.

In another embodiment, the invention provides a composition having the configuration of formula III (depicted N-terminus to C-terminus):

(fifth portion)-(fourth portion)-(first portion)-(second portion)-(third portion)    III wherein first portion is a bispecific comprising two scFv wherein the first binding domain has specific binding affinity to a tumor-specific marker or an antigen of a target cell and the second binding domain has specific binding affinity to an effector cell; the second portion comprises a release segment (RS) capable of being cleaved by a mammalian protease; the third portion is a bulking moiety; the fourth portion comprises a release segment (RS) capable of being cleaved by a mammalian protease which may be identical or different from the second portion; and the fifth portion is a bulking moiety that may be identical or may be different from the third portion. In the foregoing embodiment, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker as described herein, below. In the foregoing embodiments, the RS is selected from the group of sequences set forth in Table 4. In the foregoing embodiments, the bulking moiety is selected from the group consisting of: XTEN; albumin binding domain; albumin; IgG binding domain; polypeptides consisting of proline, serine, and alanine; fatty acid; and Fc domain. Where desired, the bulking moiety is an XTEN having at least about 90%, 91%, 92%, 93%, 94%, 95%, 96%, 97%, 98%, 99%, or 100% sequence identity to a sequence selected from the group of sequences set forth in Table 5. In the foregoing embodiments, the composition is a recombinant fusion protein. In another embodiment, the portions are linked by chemical conjugation.

The subject compositions, based on their design and specific components, address the long-felt need to provide bispecific therapeutics that have more selectivity, greater half-life, and result in less toxicity and fewer side effects once they are cleaved by proteases found in associated with the target tissues or tissues rendered unhealthy by a disease, such that the subject compositions have improved therapeutic index compared to bispecific antibody compositions known in the art. Such compositions are useful in the treatment of certain diseases, including, but not limited to cancer. It will be appreciated by those of skill in the art that the compositions of the instant invention achieve this reduction in non-specific interactions by a combination of mechanism, which include steric hindrance by locating the binding domains to the bulky XTEN molecules, steric hindrance in that the flexible, unstructured characteristic of the long flexible XTEN polypeptides, by being tethered to the composition, are able to oscillate and move around the binding domains, providing blocking between the composition and tissues or cells, as well as a reduction in the ability of the intact composition to penetrate a cell or tissue due to the large molecular mass (contributed to by both the actual molecular weight of the XTEN and due to the large hydrodynamic radius of the unstructured XTEN) compared to the size of the individual binding domains. However, the compositions are designed such that when in proximity to a target tissue or cell bearing or secreting a protease capable of cleaving the RS, or when internalized into a target cell or tissue when a binding domain has bound the ligand, the bispecific binding domains are liberated from the bulk of the XTEN by the action of the protease(s), removing the steric hindrance barrier, and is freer to exert its pharmacologic effect. The subject compositions find use in the treatment of a variety of conditions where selective delivery of a therapeutic bispecific antibody composition to a cell, tissue or organ is desired. In one embodiment, the target tissue is a cancer, which may be a leukemia, a lymphoma, or a tumor of an organ or system.

III). Pharmaceutical Compositions

The present invention provides pharmaceutical compositions comprising chimeric polypeptide assembly compositions. In one embodiment, the pharmaceutical composition comprises the chimeric polypeptide assembly and one or more pharmaceutically acceptable carriers. In another embodiment, the pharmaceutical composition comprises the chimeric polypeptide assembly of any one of the embodiments described herein and optionally, suitable formulations of carrier, stabilizers and/or excipients. In another embodiment, the pharmaceutical composition comprises the T cell binding composition of any one of the embodiments described herein and optionally, suitable formulations of carrier, stabilizers and/or excipients. Suitable excipients and acceptable carriers or include: buffering agents such as sodium citrate, dicalcium phosphate, or sodium phosphate; preservatives; co-solvents; antioxidants, including ascorbic acid and methionine; chelating agents such as EDTA; metal complexes (e.g., Zn-protein complexes); polymers, such as polyesters, polyoxyethylene-stearates, polyoxyethylene alkyl ethers, e.g. polyoxyethylene monolauryl ether, alkylphenylpolyoxyethylene ethers (Triton-X), polyoxyethylene-polyoxypropylene copolymer, and polethylene glycols; salt-forming counter-ions, such as sodium, polyhydric sugar alcohols; amino acids, such as alanine, glycine, asparagine, 2-phenylalanine, and threonine; sugars or sugar alcohols, such as trehalose, sucrose, octasulfate, sorbitol or xylitol stachyose, mannose, sorbose, xylose, ribose, myoinisitose, galactose, lactitol, ribitol, myoinisitol, polysorbate, galactitol, glycerol, cyclitols (e.g., inositol); sulfur containing reducing agents, such as glutathione, thioctic acid, sodium thioglycolate, thioglycerol, [alpha]-monothioglycerol, and sodium thio sulfate; low molecular weight proteins, such as human serum albumin, bovine serum albumin, gelatin; and hydrophilic polymers, such as polyvinylpyrrolidone.

The pharmaceutical compositions of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations of the pharmaceutical compositions are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions. In addition, the pharmaceutical compositions can also contain other pharmaceutically active compounds or a plurality of compositions of the invention.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

The pharmaceutical compositions may be administered for therapy by any suitable route including parenteral (including subcutaneous, subcutaneous by infusion pump, intramuscular, intravenous, intra-arterial, and intradermal), intravitreally, intrathecally, intraperitoneally, intraabdominally, and pulmonary. It will also be appreciated that the preferred route will vary with the condition and age of the recipient, and the disease being treated.

In some embodiments, the pharmaceutical composition comprising a chimeric polypeptide assembly of the embodiments described herein are used in a method for treatment of a disease, the method comprising administering the pharmaceutical composition to a subject with the disease according to a treatment regimen comprising one or more consecutive doses using a therapeutically effective dose. treatment regimen is part of a specified treatment cycle. In one embodiment, the specified treatment cycle comprises administration of the pharmaceutical composition twice a week, every week, every 10 days, every two weeks, every three weeks, or every month per each treatment cycle. In another embodiment, the treatment regimen results in the improvement of a clinical parameter or endpoint associated with the disease in the subject wherein the clinical parameter or endpoint is selected from one or any combination of the group consisting of tumor shrinkage as a complete, partial or incomplete response; time-to-progression, time to treatment failure, biomarker response; progression-free survival; disease free-survival; time to recurrence; time to metastasis; time of overall survival; improvement of quality of life; and improvement of symptoms. In other embodiments, the pharmaceutical composition comprising a chimeric polypeptide assembly of the embodiments described herein is prepared as a medicament for the treatment of a disease in a subject. In the foregoing embodiments of this paragraph, the disease can be carcinoma, Hodgkin's lymphoma, and non-Hodgkin's lymphoma, diffuse large B cell lymphoma, follicular lymphoma, mantle cell lymphoma, blastoma, breast cancer, ER/PR+ breast cancer, Her2+ breast cancer, triple-negative breast cancer, colon cancer, colon cancer with malignant ascites, mucinous tumors, prostate cancer, head and neck cancer, skin cancer, melanoma, genito-urinary tract cancer, ovarian cancer, ovarian cancer with malignant ascites, peritoneal carcinomatosis, uterine serous carcinoma, endometrial cancer, cervix cancer, colorectal, uterine cancer, mesothelioma in the peritoneum, kidney cancer, Wilm's tumor, lung cancer, small-cell lung cancer, non-small cell lung cancer, gastric cancer, stomach cancer, small intestine cancer, liver cancer, hepatocarcinoma, hepatoblastoma, liposarcoma, pancreatic cancer, gall bladder cancer, cancers of the bile duct, esophageal cancer, salivary gland carcinoma, thyroid cancer, epithelial cancer, arrhenoblastoma, adenocarcinoma, sarcoma, and B-cell derived chronic lymphatic leukemia. In one embodiment, the medicament is prepared for administration to the subject by the parenteral route (by intra-arterial or intravenous routes). In another embodiment, the medicament is prepared for administration to a subject by the subcutaneous route. In another embodiment, the medicament is prepared for the treatment of a disease in a subject for administration to the subject by the intradermal route. Where desired, the pharmaceutical composition comprising a chimeric polypeptide assembly of the embodiments described herein is prepared as a medicament for treatment of a disease in a subject wherein administration is by the intraabdominal or intraperitoneal route for the treatment of tumors and/or ascites in the abdominal cavity.

In another aspect, the invention relates to formulations of the pharmaceutical compositions. In one embodiment, the pharmaceutical composition may be supplied as a lyophilized powder to be reconstituted prior to administration. In one embodiment, the pharmaceutical composition may be supplied as a lyophilized powder to be reconstituted using normal saline, D5 water, lactated Ringer's, and the like, for administration. In another embodiment, the composition may also be supplied in a liquid form, which can be administered directly to a patient. In one embodiment, the pharmaceutical composition is supplied as a liquid in a pre-filled syringe for a single injection. In one embodiment, the pharmaceutical composition is supplied as a liquid in a vial. In another embodiment, the pharmaceutical composition is supplied as a lyophilized powder in a vial. For liquid formulations of the pharmaceutical composition embodiments, a desired property is that the formulation be supplied in a form that can pass through a needle for intravenous, intramuscular, intraarticular, or subcutaneous administration. In one embodiment, the pharmaceutical composition is in a liquid form. In another embodiment, the pharmaceutical composition is in a pre-filled syringe for use as a single injection. In one embodiment, the pharmaceutical composition is formulated in a saline buffer solution at a concentration of at least at least 1 µM, or at least 10 µM, or at least 100 µM, or at least 1 mM, or at least 2 mM, or at least 3 mM, or at least 4 mM, or at least 5 mM, or at least 6 mM, or at least 7 mM, or at least 8 mM, or at least 9 mM, or at least 10 mM, wherein such solution can be passed through a 25, 26, 27, 28, 29, 30, 31, or 32 gauge needle for intradermal, subcutaneous, intravenous, intra-arterial, intraabdominal, intraperitoneal, intrathecal, or intramuscular administration. Syringe pumps may also be used to deliver the pharmaceutical compositions of the invention. Such devices are described in U.S. Pat. Nos. 4,976,696; 4,933,185; 5,017, 378; 6,309,370; 6,254,573; 4,435,173; 4,398,908; 6,572, 585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

IV). Methods and Uses of Chimeric Polypeptide Assembly Compositions

The present invention provides cleavable chimeric polypeptide assembly compositions, or ProTIA (Protease Triggered Immune Activator), and pharmaceutical compositions comprising a chimeric polypeptide assembly that are particularly useful in medical settings; for example in the prevention, treatment and/or the amelioration of certain cancers, tumors or inflammatory diseases.

A number of therapeutic strategies have been used to design the chimeric polypeptide assembly compositions for use in methods of treatment of a subject with a cancerous disease, including the modulation of T cell responses by targeting TcR signalling, particularly using VL and VH portions of the anti-human CD3 monoclonal antibodies that are widely used clinically in immunosuppressive regimes. The CD3-specific monoclonal OKT3 was the first such monoclonal approved for use in humans (Sgro, Toxicology 105 (1995), 23-29) and is widely used clinically as an immunosuppressive agent in transplantation (Chatenoud L: Immunologic monitoring during OKT3 therapy. Clin Transplant 7:422-430, 1993). Moreover, anti-CD3 monoclonals can induce partial T cell signalling and clonal anergy (Smith, J. Exp. Med. 185 (1997), 1413-1422). OKT3 reverses allograft tissue rejection most probably by blocking the function of all T cells, which play a major role in acute rejection. The OKT3 reacts with and blocks the function of the CD3 complex in the membrane of T cells; the CD3 complex being associated with the antigen recognition structure of T cells (TCR), which is essential for signal transduction. These and other such CD3 specific antibodies are able to induce various T cell responses, including cytokine production (Von Wussow, Human gamma interferon production by leukocytes induced with monoclonal antibodies recognizing T cells. J. Immunol. 127:1197-1200 (1981), proliferation and suppressor T-cell induction. Depending on the conditions, CD3 specific monoclonal antibody can either inhibit or induce cytotoxicity (Kimball J A, et al. The OKT3 Antibody Response Study: a multicentre study of human anti-mouse antibody (HAMA) production following OKT3 use in solid organ transplantation. Transplant Immunol. 3:212-221 (1995). In cancer, attempts have been made to utilize cytotoxic T cells to lyse cancer cells. To effect target cell lysis, cytotoxic T cells require direct cell-to-cell contact; the TCR on the cytotoxic T cell must recognize and engage the appropriate antigen on the target cell. This creates the immulogic synapse that, in turn initiates a signaling cascade within the cytotoxic T cell, causing T-cell activation and the production of a variety of cytotoxic cytokines and effector molecules. Perforin and granzymes are highly toxic molecules that are stored in preformed granules that reside in activated cytotoxic T cells. After recognition of the target cell, the cytoplasmic granules of the engaged cytotoxic T cells migrate toward the cytotoxic T-cell membrane, ultimately fusing with it and releasing their contents in directed fashion into the immunolgical synapse to form a pore within the membrane of the target cell, disrupting the tumor cell plasma membrane. The created pore acts as a point of entry for granzymes; a family of serine proteases that that induce apoptosis of the tumor cells. These and other effector molecules are described more fully, above. The invention contemplates methods of use of bispecific compositions that are engineered to target a range of malignant cells, such as tumors, in addition to the effector cells, in order to initiate target cell lysis and to effect a beneficial therapeutic outcome by the mechanisms described, above. The compositions are designed such that one binding domain binds and engages CD3 to activate the cytotoxic T cell while the second binding domain can be designed to target a variety of different target cell antigens that are characteristic of specific malignancies; bridging them together for the creation of the immunological synapse. In a particular advantage of the design, the physical binding of the cytotoxic effector cell and the cancer cell eliminates the need for antigen processing, MHCl/B2-microglobulin, as well as co-stimulatory molecules. Examples of important tumor cell markers include the epithelial cell adhesion molecule (Ep-CAM); a cell surface glycoprotein expressed in multiple solid tumors. Another example is HER2/neu, also expressed in several solid tumors, such as breast cancer. Other cancer cell markers and representative VL and VH sequences that can be utilized to create binding domains of the inventive chimeric polypeptide assembly compositions are listed in Table 2 or described herein. Because of the range of tumor-specific markers (more extensively described, above) that can be engineered into the various embodiments of the subject compositions antibodies, it will be appreciated that the resulting compositions will have utility against a variety of cancers, including solid and hematological tumors. In one embodiment, the invention provides a method of treatment of a subject with a tumor. The tumor being treated can comprise tumor cells arising from a cell selected from the group consisting of stromal cell, fibroblasts, myofibroblasts, glial cells, epithelial cells, fat cells, lymphocytic cells, vascular cells, smooth muscle cells, mesenchymal cells, breast tissue cells, prostate cells, kidney cells, brain cells, colon cells, ovarian cells, uterine cells, bladder cells, skin cells, stomach cells, genito-urinary tract cells, cervix cells, uterine cells, small intestine cells, liver cells, pancreatic cells, gall bladder cells, bile duct cells, esophageal cells, salivary gland cells, lung cells, and thyroid cells. In a further advantage of the compositions, as the cytotoxic effector cells are not consumed during the damage/destruction of the bridged target cancer cell, after causing lysis of one target cell, an activated effector cell can release and move on through the local tissue towards other target cancer cells, bind the target antigen, and initiate additional cell lysis. In addition, it is contemplated that in a localized environment like a solid tumor, the release of effector cell molecules such as perforin and granzymes will result in damage to tumor cells that are adjacent but not bound by a given molecule of the bispecific binding domains, resulting in stasis of growth or regression of the tumor.

Accordingly, the utility of the invention will be understood; that after administration of a therapeutically effective dose of pharmaceutical composition comprising a chimeric polypeptide assembly described herein to a subject with a cancer or tumor having the target cell marker, the composition can be acted upon by proteases in association with the cancer or tumor cells, releasing the bispecific first portion binding domains such that an immunological synapse can be created by the linking of the target cell and a effector cell, with the result that effector cell-derived effector molecules capable of lysing the target cell are released into the synapse, leading to apoptosis, cytolysis, or death of the target cancer or tumor cell. Furthermore, it will be appreciated by one of skill in the art that use of the chimeric polypeptide assembly compositions can result in a sustained and more generalized beneficial therapeutic effect than a "single kill" once the immunological synapse is formed by the binding of the released binding domains to the effector cell and target cancer cell.

In one aspect, the invention relates to methods of treating a disease in a subject, such as a cancer or an inflammatory disorder. In some embodiments, the invention provides a method of treating a disease in a subject, comprising administering to the subject in need thereof a therapeutically effective amount of a pharmaceutical composition comprising a chimeric polypeptide assembly described herein. A therapeutically effective amount of the pharmaceutical composition may vary according to factors such as the disease state, age, sex, and weight of the individual, and the ability of the antibody or antibody portion to elicit a desired response in the individual. A therapeutically effective amount is also one in which any toxic or detrimental effects of the subject compositions are outweighed by the therapeutically beneficial effects. A prophylactically effective amount refers to an amount of pharmaceutical composition required for the period of time necessary to achieve the desired prophylactic result.

In one embodiment of the method of treating a disease in a subject, the disease for treatment can be carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome. The therapeutically effective amount can produce a beneficial effect in helping to treat (e.g., cure or reduce the severity) or prevent (e.g., reduce the likelihood of recurrence) of a cancer or a tumor. In another embodiment of the method of treating the disease in a subject, the pharmaceutical composition is administered to the subject as one or more therapeutically effective doses administered twice weekly, once a week, every two weeks, every three weeks, or monthly. In another embodiment of the method, the pharmaceutical composition is administered to the subject as one or more doses over a period of at least two weeks, or at least one month, or at least two months, or at least three months, or at least four months, or at least five months, or at least six months. In another embodiment of the method, a first low priming dose is administered to the subject, followed by one or more higher maintenance doses over the dosing schedule of at least two weeks, or at least one month, or at least two months, or at least three months, or at least four months, or at least five months, or at least six months. The initial priming dose administered is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, and one or more subsequent maintenance dose(s) administered is selected from the group consisting of at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least about 0.3 mg/kg, at least about 0.4. mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In another embodiment of the method, the pharmaceutical composition is administered to the subject intradermally, subcutaneously, intravenously, intra-arterially, intra-abdominally, intraperitoneally, intrathecally, or intramuscularly. In another embodiment of the method, the pharmaceutical composition is administered to the subject as one or more therapeutically effective bolus doses or by infusion of 5 minutes to 96 hours as tolerated for maximal safety and efficacy. In another embodiment of the method, the pharmaceutical composition is administered to the subject as one or more therapeutically effective bolus doses or by infusion of 5 minutes to 96 hours, wherein the dose is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least 0.3 mg/kg, at least 0.4. mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In another embodiment of the method, the pharmaceutical composition is administered to the subject as one or more therapeutically effective bolus doses or by infusion over a period of 5 minutes to 96 hours, wherein the administration to the subject results in a plasma concentration of the chimeric polypeptide assembly of at least about 0.1 ng/mL to at least about 2 μg/mL or more in the subject that is maintained for at least about 3 days, at least about 7 days, at least about 10 days, at least about 14 days, or at least about 21 days. In the foregoing embodiments of the method, the subject can be mouse, rat, monkey, and human.

In particular, the pharmaceutical compositions comprising a chimeric polypeptide assembly can be used for the treatment of epithelial cancer, preferably adenocarcinomas, or minimal residual disease, more preferably early solid tumor, advanced solid tumor or metastatic solid tumor. In addition, the pharmaceutical compositions comprising a chimeric polypeptide assembly provided in this invention are useful in the treatment of sarcomas. In addition, the pharmaceutical compositions comprising a chimeric polypeptide assembly provided in this invention are useful in the treatment of lymphomas and leukemias, including primary hematologic malignancies including acute or chronic lymphocytic leukemias, acute or chronic myelogenous leukemias, myeloproliferative neoplastic disorders, or myelodysplastic disorders, B-cell disorders such as B-cell lymphoma, Hodgkin's lymphoma, and non-Hodgkin's lymphoma, diffuse large B cell lymphoma, follicular lymphoma, mantle cell lymphoma, blastoma, B-cell derived chronic lymphatic leukemia (B-CLL) and/or having a B-cell related autoimmune disease such as myasthenia gravis, Morbus Basedow, Hashimoto thyroiditis, or Goodpasture syndrome. In addition, the pharmaceutical compositions comprising a chimeric polypeptide assembly provided in this invention are useful in the treatment of cancers leading to ascites, including genito-urinary tract cancer, ovarian cancer, ovarian cancer with malignant ascites, peritoneal carcinomatosis, uterine serous carcinoma, endometrial cancer, cervix cancer, colorectal, uterine cancer, mesothelioma in the peritoneum, pancreatic cancer, colon cancer, colon cancer with malignant ascites, and gastric cancer.

In one aspect, the invention provides a method of for achieving a beneficial effect in a cancer or tumor mediated by administration of pharmaceutical compositions comprising chimeric polypeptide assembly compositions. In one embodiment of the method, the invention provides the use of a pharmaceutical composition comprising a chimeric polypeptide assembly in a method of treatment of a cancer or tumor in a subject in need thereof by administration of a therapeutically effective amount of the pharmaceutical composition in which one binding domain of the chimeric polypeptide assembly composition is derived from a parental antibody that binds to an effector cell CD3 antigen and a second binding domain is derived from a parental antibody that binds to an effector cell target antigen selected from the group consisting of alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. In one embodiment of the method, the administration of the therapeutically effective amount of the pharmaceutical composition leads to the eradication or amelioration of the underlying cancer or tumor disorder such that an improvement is observed in the subject, notwithstanding that the subject may still be afflicted with the underlying disorder.

In another embodiment, the invention provides use of a pharmaceutical composition comprising a chimeric polypeptide assembly in a method of treatment of a cancer or tumor in a subject by administration of a therapeutically effective amount of the pharmaceutical composition in which one binding domain of the chimeric polypeptide assembly composition is derived from a parental antibody directed to an effector cell selected from the group consisting of the antibodies of Table 1 and a second binding domain is derived from a parental antibody that binds to an target cell target antigen selected from the group consisting of the antibodies of Table 2. In another embodiment, the invention provides use of a pharmaceutical composition comprising a chimeric polypeptide assembly in a method of treatment of a cancer or tumor in a subject by administration of a therapeutically effective amount of the pharmaceutical composition in which one binding domain of the chimeric polypeptide assembly composition comprises VL and VH sequences derived from a parental antibody directed to an effector cell selected from the group of sequences set forth in Table 1 and a second binding domain comprises paired VL and VH sequences derived from a parental antibody directed to a target cell antigen selected from the group consisting of the antibodies of Table 2. In another embodiment, the invention provides use of a pharmaceutical composition comprising a chimeric polypeptide assembly in a method of treatment of a cancer or tumor in a subject by administration of a therapeutically effective amount of the pharmaceutical composition in which one binding domain of the chimeric polypeptide assembly composition comprises VL and VH sequences derived from a parental antibody directed to an effector cell linked to a second binding domain comprises paired VL and VH sequences derived from a parental antibody directed to a target cell antigen wherein the linked binding domains have an amino acid sequence with at least 90%, 91%, 92%, 93%, 94%, 95%, 96%, 97%, 98%, 99%, or 100% sequence identity to an amino acid sequence set forth in Table 13. In another embodiment, the invention provides use of a pharmaceutical composition comprising a chimeric polypeptide assembly in a method of treatment of a cancer or tumor in a subject by administration of a therapeutically effective amount of the pharmaceutical composition comprising a chimeric polypeptide assembly comprising an amino acid sequence with at least 90%, 91%, 92%, 93%, 94%, 95%, 96%, 97%, 98%, 99%, or 100% sequence identity to an amino acid sequence set forth in Table 10 or Table 12. In one embodiment, the pharmaceutical composition doses of the method are administered as a bolus dose. In another embodiment, the pharmaceutical composition doses of the method are each administered by intravenous infusion. In another embodiment, the pharmaceutical composition doses of the method are each administered by intraabdominal infusion. In another embodiment, the pharmaceutical composition doses of the method are each administered by intra-arterial infusion. In another embodiment, the pharmaceutical composition doses of the method are each administered by subcutaneous injection. In another embodiment, the pharmaceutical composition doses of the method are each administered by intramuscular injection. In another embodiment, the pharmaceutical composition doses of the method are each administered by intraabdominal infusion. In the foregoing embodiments of this paragraph, the subject is selected from the group consisting of mouse, rat, dog, monkey, and human.

In another aspect, the invention relates to a method of treating a cancer or a tumor in a subject according to a treatment regimen. In one embodiment, the invention provides a method of treating a cancer or a tumor in a subject comprising administering to the subject with the disease according to a treatment regimen comprising one or more consecutive doses of a therapeutically effective amount of a pharmaceutical composition comprising a chimeric polypeptide assembly composition disclosed herein. In one embodiment, the invention provides a method of treating a cancer or a tumor in a subject comprising administering to the subject with the disease according to a treatment regimen comprising one or more consecutive doses of a therapeutically effective amount of a pharmaceutical composition comprising a chimeric polypeptide assembly wherein the administration of the therapeutically effective amount of a pharmaceutical composition to the subject achieves a beneficial therapeutic effect. In another embodiment, the invention provides a method of treating a cancer or a tumor in a subject comprising administering to the subject with the disease according to a treatment regimen comprising one or more consecutive doses of a therapeutically effective amount of a pharmaceutical composition comprising a chimeric polypeptide assembly wherein the treatment regimen results in the improvement of a clinical parameter or endpoint associated with the disease in the subject. In the foregoing, the clinical parameter or endpoint is selected from one or any combination of the group consisting of tumor shrinkage as a complete, partial or incomplete response; time-to-progression; time to treatment failure; biomarker response; progression-free survival; disease free-survival; time to recurrence; time to metastasis; time of overall survival; improvement of quality of life; and improvement of symptoms.

In another aspect, the invention relates to a method of use in which the treatment regimen is part of a specified treatment cycle. In one embodiment of the method, the specified treatment cycle of the treatment regimen comprises administration of a pharmaceutical composition comprising a chimeric polypeptide assembly twice a week, every week, every 10 days, every two weeks, every three weeks, or every month per each treatment cycle. In another embodiment of the method, the treatment regimen is used in treatment of a disease, wherein the disease is selected from the group consisting of carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome.

In another aspect, the invention relates to improved methods of inducing death of a target cell, such as a cancer cell, utilizing the chimeric polypeptide assembly compositions, wherein the method effects death or induces apoptosis in the target cell or tissue, but with reduced toxicity and side effects. In a particular advantage of the inventive methods, the enhanced properties of the chimeric polypeptide assembly compositions permit lower-dose pharmaceutical formulations or treatment methods using a reduced dosage, reduced dosing frequency and a superior dose regimen, both because of targeted delivery to tissues and cells and because of enhanced pharmacokinetic properties, resulting in a superior therapeutic index; i.e., improved efficacy with reduced toxicity. Consequently, the subject compositions can have superior efficacy and safety compared to the corresponding first portion binding domains not linked to the RS and bulking moiety because of the ability of the attached bulking moiety to reduce the non-specific binding to healthy tissues and to prevent extravasation from the circulatory system in healthy tissue, while permitting enhanced penetration and binding into the cancer or tumor tissue upon the cleavage of the RS and release of the bispecific first portion binding domains; thus resulting in a differential compartmentalization of the prodrug form versus the released first portion upon cleavage of the composition. In one embodiment, the invention provides a method of inducing death of a target cell, the method comprising contacting the target cell and an effector cell with a chimeric polypeptide assembly described herein, wherein the contact results in an effect in the target cell selected from the group consisting of loss of membrane integrity, pyknosis, karyorrhexis, inducement of the intrinsic pathway of apoptosis, inducement of the extrinsic pathway of apoptosis, apoptosis, cell lysis, and cell death. The effect can be determined in an in vitro cell-based assay comprising a mixed population of the target cells and the effector cells, and an effective amount of the chimeric polypeptide assembly having binding affinity for antigens of the target cell and the effector cell. Non-limiting examples of target cell antigens include, but are not limited to a tumor specific marker antigen selected from the group consisting of alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2 and the effector cell is a is T cell wherein the effector cell antigen is CD3.

In other embodiments, the invention provides methods of inducing death of a target cell in a subject having a cancer comprising a population of the target cell. In one embodiment of the method, the method comprises administering a therapeutically effective amount of a pharmaceutical composition comprising the chimeric polypeptide assembly to the subject. In another embodiment of the method, the method comprises administering the chimeric polypeptide assembly as one or more consecutively administered therapeutically effective doses of the pharmaceutical composition. In another embodiment of the method, the method comprises determining the amount of a pharmaceutical composition comprising the chimeric polypeptide assembly needed to achieve a therapeutic effect in the subject having the cancer and administering the amount as one or more consecutively doses to the subject. In the foregoing methods, the cancer is selected from the group consisting of carcinoma, Hodgkin's lymphoma, and non-Hodgkin's lymphoma, diffuse large B cell lymphoma, follicular lymphoma, mantle cell lymphoma, blastoma, breast cancer, ER/PR+ breast cancer, Her2+ breast cancer, triple-negative breast cancer, colon cancer, colon cancer with malignant ascites, mucinous tumors, prostate cancer, head and neck cancer, skin cancer, melanoma, genito-urinary tract cancer, ovarian cancer, ovarian cancer with malignant ascites, peritoneal carcinomatosis, uterine serous carcinoma, endometrial cancer, cervix cancer, colorectal, uterine cancer, mesothelioma in the peritoneum, kidney cancer, Wilm's tumor, lung cancer, small-cell lung cancer, non-small cell lung cancer, gastric cancer, stomach cancer, small intestine cancer, liver cancer, hepatocarcinoma, hepatoblastoma, liposarcoma, pancreatic cancer, gall bladder cancer, cancers of the bile duct, esophageal cancer, salivary gland carcinoma, thyroid cancer, epithelial cancer, arrhenoblastoma, adenocarcinoma, sarcoma, and B-cell derived chronic lymphatic leukemia. In another embodiment of the method, the method comprises administering a therapeutically effective amount of a pharmaceutical composition comprising the chimeric polypeptide assembly to the subject wherein the method results in an improvement of a clinical parameter or endpoint. Exemplary clinical parameters or endpoints can be overall survival, symptom endpoints, disease-free survival, objective response rate, complete response, duration of response, progression-free survival, time to progression, time-to-treatment failure, tumor measurement, tumor size, tumor response rate, time to metastasis, and biomarker concentration. In another embodiment of the method, the method comprises administering a therapeutically effective amount of a pharmaceutical composition comprising the chimeric polypeptide assembly to the subject wherein the method results in a reduction in the frequency, duration, or severity in diagnostically associated side effects in the subject compared to administration of a comparable dose, in mmoles/kg, to a comparable subject of a composition comprising the first portion and an absence the second portion and third portion of the chimeric polypeptide assembly, wherein the side effects are selected from the group consisting of increased plasma levels of IL-2, increased plasma levels of TNF-alpha, increased plasma levels of IFN-gamma, sepsis, febrile neutropenia, neurotoxicity, convulsions, encephalopathy, cytokine release syndrome, speech disturbance, equilibrium disturbance, fever, headache, confusion, hypotension, neutropenia, nausea, impaired consciousness, disorientation, and increased liver enzymes.

In one embodiment, the method comprises administering a therapeutically-effective amount of a pharmaceutical composition comprising a chimeric polypeptide assembly to a subject in need thereof that results in an improvement in at least one parameter, endpoint, physiologic condition, or clinical outcome mediated by the bispecific first portion binding domains. The methods contemplate administration of the pharmaceutical composition by any route appropriate for the disease, disorder or condition being treated, including intradermally, subcutaneously, intramuscularly, intra-abdominally, or intravenously.

The methods of the invention may include administration of consecutive doses of a therapeutically effective amount of the pharmaceutical composition for a period of time sufficient to achieve and/or maintain the desired parameter or clinical effect, and such consecutive doses of a therapeutically effective amount establishes the therapeutically effective dose regimen for the pharmaceutical composition; i.e., the schedule for consecutively administered doses, wherein the doses are given in therapeutically effective amounts to result in a sustained beneficial effect on any clinical sign or symptom, aspect, measured parameter or characteristic of a cancer disease state or condition, including, but not limited to, those cancers and tumors described herein.

For the inventive methods, longer acting chimeric polypeptide assembly compositions or pharmaceutical compositions comprising the chimeric polypeptide assembly compositions are preferred, so as to improve patient convenience, to increase the interval between doses and to reduce the amount of drug required to achieve a sustained effect. In one embodiment, a method of treatment comprises administration of a therapeutically effective dose of a pharmaceutical composition comprising the chimeric polypeptide assembly to a subject in need thereof that results in a gain in time spent within a therapeutic window established for the targeting components of the pharmaceutical composition compared to the corresponding targeting components not linked to the fusion protein and administered at a comparable dose to a subject. In some cases, the gain in time spent within the therapeutic window is at least about three-fold, or at least about four-fold, or at least about five-fold, or at least about six-fold, or at least about eight-fold, or at least about 10-fold, or at least about 20-fold, or at least about 40-fold, or at least about 50-fold, or at least about 100-fold greater compared to the corresponding targeting components not linked to the fusion protein and administered at a comparable dose to a subject. The methods further provide that administration of multiple consecutive doses of a pharmaceutical composition administered using a therapeutically effective dose regimen to a subject in need thereof can result in a gain in time between consecutive $C_{max}$ peaks and/or $C_{min}$ troughs for blood levels of the composition compared to the corresponding targeting components not linked to the fusion protein. In the foregoing embodiment, the gain in time spent between consecutive $C_{max}$ peaks and/or $C_{min}$ troughs can be at least about three-fold, or at least about four-fold, or at least about five-fold, or at least about six-fold, or at least about eight-fold, or at least about 10-fold, or at least about 20-fold, or at least about 40-fold, or at least about 50-fold, or at least about 100-fold longer compared to the corresponding targeting component(s) not linked to the fusion protein and administered using a comparable dose regimen established for the targeting components. In the embodiments hereinabove described in this paragraph the administration of the fusion protein or pharmaceutical composition can result in an improvement in at least one parameter known to be useful for assessing the subject cancer or tumor using a lower unit dose in moles of fusion protein compared to the corresponding targeting components not linked to the fusion protein and administered at a comparable unit dose or dose regimen to a subject.

In one embodiment, the administration of a pharmaceutical composition comprising a subject chimeric polypeptide assembly composition can result in an improvement in one of the clinical, biochemical or physiologic parameters that is greater than that achieved by administration of the first portion not linked to the second and third portions of the composition, determined using the same assay or based on a measured clinical parameter or endpoint. In another embodiment, administration of the pharmaceutical composition can result in improvement two or more clinical or metabolic-related parameters or endpoints, each mediated by one of the different targeting moieties that collectively result in an enhanced effect compared the targeting moiety component not linked to XTEN, determined using the same assays or based on measured clinical parameters. In one embodiment, administration of the pharmaceutical composition to the subject results in improvement of a clinical parameter or endpoint wherein the clinical parameter or endpoint is selected from one or any combination of the group consisting of tumor shrinkage as a complete, partial or incomplete response; time-to-progression, time to treatment failure, biomarker response; progression-free survival; disease free-survival; time to recurrence; time of overall survival; improvement of quality of life; improvement of symptoms; and time to metastasis. In another embodiment, administration of the pharmaceutical composition can result in improvement of one or more of the foregoing clinical parameters that is at least 20% longer duration, or at least 30%, or at least 40%, or at least 50%, or at least 60%, or at least 70%, or at least 80%, or at least 90%, or at least 100% longer than the activity of the first portion not linked to the second and third portions of the composition.

In another aspect, the invention relates to a method of delivering a therapeutic agent to a tumor cell. In one embodiment, the invention provides a method of delivering a therapeutic agent to a tumor cell comprising a tumor specific marker, the method comprising administering to the target cell the chimeric polypeptide assembly of any of the embodiments described herein, wherein the therapeutic agent is delivered to the target cell via the first binding domain of the first portion specifically binding to the tumor specific marker. In one embodiment of the method, the tumor specific marker is selected from the group consisting of alpha 4 integrin, Ang2, B7-H3, B7-H6, CEACAM5, cMET, CTLA4, FOLR1, EpCAM, CCR5, CD19, HER2, HER2 neu, HER3, HER4, HER1 (EGFR), PD-L1, PSMA, CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. In another embodiment of the method of delivering a therapeutic agent to a tumor cell comprising administering to the target cell the chimeric polypeptide assembly, the chimeric polypeptide assembly comprises an amino acid sequence having at least 90%, or at least 91%, or at least 92%, or at least 93%, or at least 94%, or at least 95%, or at least 96%, or at least 97%, or at least 98%, or at least 99%, or at least 100% sequence identity to a polypeptide sequence selected from the group consisting of the sequences of Table 12. In another embodiment of the method of delivering a therapeutic agent to a tumor cell comprising administering to the target cell the chimeric polypeptide assembly, the chimeric polypeptide assembly comprises an amino acid sequence having at least 90%, or at least 91%, or at least 92%, or at least 93%, or at least 94%, or at least 95%, or at least 96%, or at least 97%, or at least 98%, or at least 99%, or at least 100% sequence identity to the polypeptide sequence set forth in FIG. 36 or FIG. 37. In another embodiment of the method of delivering a therapeutic agent to a tumor cell, wherein the tumor cell resides in a tumor in a subject, wherein the subject is selected from the group consisting of mouse, rat, monkey, dog, and human.

V). The Nucleic Acids Sequences of the Invention

In another aspect, the present invention relates to isolated polynucleotide sequences encoding the polypeptide chimeric polypeptide assembly compositions and sequences complementary to polynucleotide molecules encoding the polypeptide chimeric polypeptide assembly compositions.

In some embodiments, the invention provides polynucleotides encoding the chimeric polypeptide assembly compositions embodiments described herein, or the complement of the polynucleotide sequence. In other embodiments, the invention provides isolated polynucleotide sequences encoding the first portion, or the second portion, or the third portion of any of the embodiments described herein, or the complement of the polynucleotide sequences. In one embodiment, the invention provides an isolated polynucleotide sequence encoding a chimeric polypeptide assembly fusion protein consisting of an amino acid sequence with at least 90%, 91%, 92%, 93%, 94%, 95%, 96%, 97%, 98%, 99%, or 100% sequence identity to an amino acid sequence set forth in Table 10 or Table 12, or the complement of the polynucleotide sequence. In one embodiment, the invention provides an isolated polynucleotide sequence encoding a chimeric polypeptide assembly composition wherein the polynucleotide sequence has at least 90%, 91%, 92%, 93%, 94%, 95%, 96%, 97%, 98%, 99%, or 100% sequence identity to a polynucleotide sequence set forth in Table 10 or Table 14.

In another embodiment, the invention provides an isolated polynucleotide sequence encoding a T cell binding composition comprising of a sequence with at least 90%, 91%, 92%, 93%, 94%, 95%, 96%, 97%, 98%, 99%, or 100% sequence identity to a polynucleotide sequence set forth in Table 7, or the complement of the polynucleotide sequence.

In another aspect, the invention relates to methods to produce polynucleotide sequences encoding the chimeric polypeptide assembly composition embodiments, or sequences complementary to the polynucleotide sequences, including homologous variants thereof, as well as methods to express the fusion proteins expressed by the polynucleotide sequences. In general, the methods include producing a polynucleotide sequence coding for the proteinaceous chimeric polypeptide assembly composition components and expressing the resulting gene product and assembling nucleotides encoding the components, ligating the components in frame, and incorporating the encoding gene into an expression vector appropriate for a host cell. For production of the encoded fusion protein of the chimeric polypeptide assembly, the method includes transforming an appropriate host cell with the expression vector, and culturing the host cell under conditions causing or permitting the resulting fusion protein to be expressed in the transformed host cell, thereby producing the fusion protein polypeptide, which is recovered by methods described herein or by standard protein purification methods known in the art. Standard recombinant techniques in molecular biology are used to make the polynucleotides and expression vectors of the present invention.

In accordance with the invention, nucleic acid sequences that encode chimeric polypeptide assembly compositions (or its complement) are used to generate recombinant DNA molecules that direct the expression in appropriate host cells. Several cloning strategies are suitable for performing the present invention, many of which are used to generate a construct that comprises a gene coding for a composition of the present invention, or its complement. In one embodiment, the cloning strategy is used to create a gene that encodes a chimeric polypeptide assembly construct that comprises nucleotides encoding the chimeric polypeptide assembly that is used to transform a host cell for expression of the composition. In the foregoing embodiments hereinabove described in this paragraph, the genes can comprise nucleotides encoding the binding moieties, release segments, and the bulking moieties in the configurations disclosed herein.

In one approach, a construct is first prepared containing the DNA sequence corresponding to chimeric polypeptide assembly construct. Exemplary methods for the preparation of such constructs are described in the Examples. The construct is then used to create an expression vector suitable for transforming a host cell, such as a prokaryotic host cell for the expression and recovery of the chimeric polypeptide assembly construct. Where desired, the host cell is an E. coli. Exemplary methods for the creation of expression vectors, the transformation of host cells and the expression and recovery of XTEN are described in the Examples.

The gene encoding for the chimeric polypeptide assembly construct can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate sequences of polynucleotides encoding the various components (e.g., binding domains, linkers, release segments, and XTEN) genes of a desired length and sequence. Genes encoding chimeric polypeptide assembly compositions are assembled from oligonucleotides using standard techniques of gene synthesis. The gene design can be performed using algorithms that optimize codon usage and amino acid composition appropriate for the E. coli host cell utilized in the production of the chimeric polypeptide assembly. In one method of the invention, a library of polynucleotides encoding the components of the constructs is created and then assembled, as described above. The resulting genes are then assembled and the resulting genes used to transform a host cell and produce and recover the chimeric polypeptide assembly compositions for evaluation of its properties, as described herein.

The resulting polynucleotides encoding the chimeric polypeptide assembly sequences can then be individually cloned into an expression vector. The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature. Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated.

The invention provides for the use of plasmid expression vectors containing replication and control sequences that are compatible with and recognized by the host cell, and are operably linked to the gene encoding the polypeptide for controlled expression of the polypeptide. The vector ordinarily carries a replication site, as well as sequences that encode proteins that are capable of providing phenotypic selection in transformed cells. Such vector sequences are well known for a variety of bacteria, yeast, and viruses. Useful expression vectors that can be used include, for example, segments of chromosomal, non-chromosomal, and synthetic DNA sequences. "Expression vector" refers to a DNA construct containing a DNA sequence that is operably linked to a suitable control sequence capable of effecting the expression of the DNA encoding the polypeptide in a suitable host. The requirements are that the vectors are replicable and viable in the host cell of choice. Low- or high-copy number vectors may be used as desired.

Suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. Yeast expression systems that can also be used in the present invention include, but are not limited to, the non-fusion pYES2 vector (Invitrogen), the fusion pYESHisA, B, C (Invitrogen), pRS vectors and the like. The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell. Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)], all is operably linked to the DNA encoding CFXTEN polypeptides. Promoters for use in bacterial systems can also contain a Shine-Dalgarno (S.D.) sequence, operably linked to the DNA encoding chimeric polypeptide assembly polypeptides.

VI). Methods of Making the Compositions of the Invention

In another aspect, the invention relates to methods of making the chimeric polypeptide assembly compositions at high fermentation expression levels of functional protein using an *E. coli* host cell, as well as providing expression vectors encoding the constructs useful in methods to produce the cytotoxically active polypeptide construct compositions at high expression levels.

In one embodiment, the method comprises the steps of 1) preparing the polynucleotide encoding the chimeric polypeptide assembly fusion protein of any of the embodiments disclosed herein, 2) cloning the polynucleotide into an expression vector, which can be a plasmid or other vector under control of appropriate transcription and translation sequences for high level protein expression in a biological system, 3) transforming an appropriate *E. coli* host cell with the expression vector, and 4) culturing the host cell in conventional nutrient media under conditions suitable for the expression of the chimeric polypeptide assembly composition. Where desired, the *E. coli* host cell is BL21 Gold. By the method, the expression of the chimeric polypeptide assembly fusion protein the results in fermentation titers of at least 0.1 g/L, or at least 0.2 g/L, or at least 0.3 g/L, or at least 0.5 g/L, or at least 0.6 g/L, or at least 0.7 g/L, or at least 0.8 g/L, or at least 0.9 g/L, or at least 1 g/L of the expressed fusion protein as a component of a crude expression product of the host cell and wherein at least 70%, or at least 80%, or at least 90%, or at least 95%, or at least 97%, or at least 99% of the first and the second binding domains of the expressed fusion protein are correctly folded. As used herein, the term "correctly folded" means that the binding domain protein has the ability to specifically bind its target ligand. In another embodiment, the invention provides a method for producing a chimeric polypeptide assembly composition, the method comprising culturing in a fermentation reaction a host cell that comprises a vector encoding a polypeptide comprising the chimeric polypeptide assembly compositions under conditions effective to express the polypeptide product at a concentration of more than about 10 milligrams/gram of dry weight host cell (mg/g), or at least about 250 mg/g, or about 300 mg/g, or about 350 mg/g, or about 400 mg/g, or about 450 mg/g, or about 500 mg/g of said polypeptide when the fermentation reaction reaches an optical density of at least 130 at a wavelength of 600 nm, and wherein the first and the second binding domains of the expressed fusion protein are correctly folded. In another embodiment, the invention provides a method for producing a chimeric polypeptide assembly composition, the method comprising culturing in a fermentation reaction a host cell that comprises a vector encoding a polypeptide comprising the chimeric polypeptide assembly compositions under conditions effective to express the polypeptide product at a concentration of more than about 10 milligrams/gram of dry weight host cell (mg/g), or at least about 250 mg/g, or about 300 mg/g, or about 350 mg/g, or about 400 mg/g, or about 450 mg/g, or about 500 mg/g of said polypeptide when the fermentation reaction reaches an optical density of at least 130 at a wavelength of 600 nm, and wherein the expressed polypeptide product is soluble.

The following are examples of compositions, methods, and treatment regimens of the invention. It is understood that various other embodiments may be practiced, given the general description provided above.

EXAMPLES

Example 1: Construction of ProTIA Construct with Anti-EpCAM-Anti-CD3-XTEN with Release Segment and XTEN The gene encoding anti-EpCAM/anti-CD3 tandem scFv followed with one of the multi-specific release segment sequences (BSRS-1, amino acid sequence LSGRSDNHSPLGLAGS (SEQ ID NO: 1)) was synthesized at Genescript, which introduced NdeI and BsaI restriction sites that are compatible with the NdeI and BsaI sites in the pBR322-XTEN864 destination vector. Restriction digested gene fragments containing anti-EpCAM/anti-CD3 tandem scFv and the BSRS-1 were ligated into the pBR322-XTEN864 vector using T4 DNA ligase and transformed into BL21 Gold cells (New England Biolabs). Transformants were screened by DNA miniprep and the desired construct was confirmed by DNA sequencing. The final vector encodes the ProTIA molecule with the components (in the N- to C-terminus) of anti-EpCAM-anti-CD3 bispecific tandem scFv with BSRS-1 as release segment fused to XTEN_864 gene under the control of a PhoA promoter and STII secretion leader. The resulting construct is AC1278, with the DNA sequence and encoded amino acid sequence provided in Table 10.

Another anti-EpCAM anti-CD3-XTEN with Release Segment, designated AC1476 and with the DNA sequence and encoded amino acid sequence provided in Table 10 as well, was constructed in a similar manner into base vector pYS0044-XTEN864-H6 base vector.

The underscored sequence represents signal peptide, which is cleaved off during secretion and is absent in the final mature protein.

TABLE 10

DNA and amino acid sequence of AC1278 and AC1476 anti-EpCAM-anti-CD3-XTEN with Release Segment

| Construct Name | DNA Sequence | SEQ ID NO: | Amino Acid Sequence* | SEQ ID NO: |
|---|---|---|---|---|
| AC1278 | ATGAAGAAAAACATCGCTTTTCTTCTTGCATC<br>TATGTTCGTTTTTTCTATTGCTACAAACGCGT<br>ACGCTCATCACCACCATCATCACCATCACGAA<br>CTGGTTATGACCCAAAGCCCGAGCAGCCTGAC<br>CGTTACCGCGGGCGAAAAGGTTACCATGAGCT<br>GCAAAAGCAGCCAAAGCCTGCTGAACAGCGGC<br>AACCAAAAGAACTACCTGACCTGGTACCAACA<br>GAAGCCGGGTCAGCCGCCGAAACTGCTGATCT<br>ACTGGGCGAGCACCCGTGAGAGCGGCGTTCCG<br>GACCGTTTTACCGGCAGCGGCAGCGGTACCGA<br>CTTTACCCTGACCATTAGCAGCGTGCAGGCGG<br>AAGATCTGGCGGTGTACTATTGCCAAAACGAC<br>TACAGCTACCCGCTGACCTTTGGTGCGGGCAC<br>CAAACTGGAGATCAAGGGTGGCGGTGGCAGCG<br>GCGGTGGTGGCAGCGGCGGCGGTGGCAGCGAG<br>GTTCAGCTGCTGGAACAGAGCGGCGCGGAGCT<br>GGTGCGTCCGGGTACCAGCGTTAAGATCAGCT<br>GCAAGGCGAGCGGTTATGCGTTCACCAACTAC<br>TGGCTGGGTTGGGTGAAGCAACGTCCGGGTCA<br>CGGTCTGGAGTGGATCGGCGACATTTTCCCGG<br>GCAGCGGTAACATCCACTACAACGAGAAATTC<br>AAGGGTAAAGCGACCCTGACCGCGGATAAAAG<br>CAGCAGCACCGCGTATATGCAGCTGAGCGCC<br>TGACCTTCGAAGATAGCGCGGTTTACTTCTGC<br>GCGCGTCTGCGTAACTGGGATGAACCGATGGA<br>TTACTGGGGTCAGGGCACCACCGTGACCGTTA<br>GCAGCGGTGGTGGCGGCAGCGATGTTCAGCTG<br>GTGCAAAGCGGTGCGGAAGTGAAAAAGCCGGG<br>TGCGAGCGTGAAAGTTAGCTGCAAAGCGAGCG<br>GCTATACCTTCACCCGTTACACCATGCACTGG<br>GTTCGTCAGGCGCCGGGTCAGGGCCTGGAATG<br>GATCGGCTACATCAACCCGAGCCGTGGCTATA<br>CCAACTACGCGGATAGCGTGAAAGGTCGTTTC<br>ACCATTACCACCGACAAAAGCACCAGCACCGC<br>GTACATGGAACTGAGCAGCCTGCGTAGCGAGG<br>ATACCGCGACCTACTATTGCGCGCGTTACTAT<br>GATGACCACTACTGCCTGGACTATTGGGGCCA<br>AGGTACCACCGTTACCGTGAGCAGCGGTGAAG<br>GCACCAGCACCGGCAGCGGTGGTAGCGGTGGT<br>AGCGGCGGTGCGGATGACATCGTTCTGACCCA<br>AAGCCCGGCGACCCTGAGCCTGAGCCCGGGCG<br>AGCGTGCGACCCTGAGCTGCCGTGCGAGCCAG<br>AGCGTTAGCTACATGAACTGGTACCAGCAAAA<br>GCCGGGCAAAGCGCCGAAGCGTTGGATTTATG<br>ATACCAGCAAGGTTGCGAGCGGTGTTCCGGCG<br>CGTTTCAGCGGTAGCGGTAGCGGCACCGATTA<br>TAGCCTGACCATTAACAGCCTGGAGGCGGAAG<br>ATGCGGCGACCTACTACTGCCAACAATGGAGC<br>AGCAATCCGCTGACCTTCGGTGGTGGTACCAA<br>AGTTGAAATTAAGGGCACCGCCGAAGCAGCTA<br>GCGCCTCTGGCCTGTCAGGTCGTTCTGATAAC<br>CATTCCCCACTGGGTCTGGCTGGGTCTCCAGG<br>TAGCCCAGCTGGTAGCCCAACCTCTACCGAAG<br>AAGGTACCTCTGAATCCGCTACTCCAGAATCC<br>GGTCCTGGTACTAGCACTGAGCCAAGCGAAGG<br>TTCTGCTCCAGGCTCCCCGGCAGGTAGCCCTA<br>CCTCTACCGAAGAGGGCACTAGCACCGAACCA<br>TCTGAGGGTTCCGCTCCTGGCACCTCCACTGA<br>ACCGTCCGAAGGCAGTGCTCCGGGTACTTCCG<br>AAAGCGCAACTCCGGAATCCGGCCCTGGTTCT | 477 | <u>MKKNIAFLLASMFV<br>FSIATNAYA</u>HHHHH<br>HHHELVMTQSPSSL<br>TVTAGEKVTMSCKS<br>SQSLLNSGNQKNYL<br>TWYQQKPGQPPKLL<br>IYWASTRESGVPDR<br>FTGSGSGTDFTLTI<br>SSVQAEDLAVYYCQ<br>NDYSYPLTFGAGTK<br>LEIKGGGGSGGGGS<br>GGGGSEVQLLEQSG<br>AELVRPGTSVKISC<br>KASGYAFTNYWLGW<br>VKQRPGHGLEWIGD<br>IFPGSGNIHYNEKF<br>KGKATLTADKSSST<br>AYMQLSSLTFEDSA<br>VYFCARLRNWDEPM<br>DYWGQGTTVTVSSG<br>GGGSDVQLVQSGAE<br>VKKPGASVKVSCKA<br>SGYTFTRYTMHWVR<br>QAPGQGLEWIGYIN<br>PSRGYTNYADSVKG<br>RFTITTDKSTSTAY<br>MELSSLRSEDTATY<br>YCARYYDDHYCLDY<br>WGQGTTVTVSSGEG<br>TSTGSGGSGGSGGA<br>DDIVLTQSPATLSL<br>SPGERATLSCRASQ<br>SVSYMNWYQQKPGK<br>APKRWIYDTSKVAS<br>GVPARFSGSGSGTD<br>YSLTINSLEAEDAA<br>TYYCQQWSSNPLTF<br>GGGTKVEIKGTAEA<br>ASASGLSGRSDNHS<br>PLGLAGSPGSPAGS<br>PTSTEEGTSESATP<br>ESGPGTSTEPSEGS<br>APGSPAGSPTSTEE<br>GTSTEPSEGSAPGT<br>STEPSEGSAPGTSE<br>SATPESGPGSEPAT<br>SGSETPGSEPATSG<br>SETPGSPAGSPTST<br>EEGTSESATPESGP<br>GTSTEPSEGSAPGT<br>STEPSEGSAPGSPA<br>GSPTSTEEGTSTEP<br>SEGSAPGTSTEPSE<br>GSAPGTSESATPES<br>GPGTSTEPSEGSAP<br>GTSESATPESGPGS<br>EPATSGSETPGTST<br>EPSEGSAPGTSTEP<br>SEGSAPGTSESATP<br>ESGPGTSESATPES | 479 |

TABLE 10-continued

DNA and amino acid sequence of AC1278 and AC1476 anti-EpCAM-anti-CD3-XTEN with Release Segment

| Construct Name | DNA Sequence | SEQ ID NO: | Amino Acid Sequence* | SEQ ID NO: |
|---|---|---|---|---|
| | GAGCCTGCTACTTCCGGCTCTGAAACTCCAGG | | GPGSPAGSPTSTEE | |
| | TAGCGAGCCAGCGACTTCTGGTTCTGAAACTC | | GTSESATPESGPGS | |
| | CAGGTTCACCGGCGGGTAGCCCGACGAGCACG | | EPATSGSETPGTSE | |
| | GAGGAAGGTACCTCTGAGTCGGCCACTCCTGA | | SATPESGPGTSTEP | |
| | GTCCGGTCCGGGCACGAGCACCGAGCCGAGCG | | SEGSAPGTSTEPSE | |
| | AGGGTTCAGCCCCGGGTACCAGCACGGAGCCG | | GSAPGTSTEPSEGS | |
| | TCCGAGGGTAGCGCACCGGGTTCTCCGGCGGG | | APGTSTEPSEGSAP | |
| | CTCCCCTACGTCTACGGAAGAGGGTACGTCCA | | GTSTEPSEGSAPGT | |
| | CTGAACCTAGCGAGGGCAGCGCGCCAGGCACC | | STEPSEGSAPGSPA | |
| | AGCACTGAACCGAGCGAAGGCAGCGCACCTGG | | GSPTSTEEGTSTEP | |
| | CACTAGCGAGTCTGCGACTCCGGAGAGCGGTC | | SEGSAPGTSESATP | |
| | CGGGTACGAGCACGGAACCAAGCGAAGGCAGC | | ESGPGSEPATSGSE | |
| | GCCCCAGGTACCTCTGAATCTGCTACCCCAGA | | TPGTSESATPESGP | |
| | ATCTGGCCCGGGTTCCGAGCCAGCTACCTCTG | | GSEPATSGSETPGT | |
| | GTTCTGAAACCCCAGGTACTTCCACTGAACCA | | SESATPESGPGTST | |
| | AGCGAAGGTAGCGCTCCTGGCACTTCTACTGA | | EPSEGSAPGTSESA | |
| | ACCATCCGAAGGTTCCGCTCCTGGTACGTCTG | | TPESGPGSPAGSPT | |
| | AAAGCGCTACCCCTGAAAGCGGCCCAGGCACC | | STEEGSPAGSPTST | |
| | TCTGAAAGCGCTACTCCTGAGAGCGGTCCAGG | | EEGSPAGSPTSTEE | |
| | CTCTCCAGCAGGTTCTCCAACCTCCACTGAAG | | GTSESATPESGPGT | |
| | AAGGCACCTCTGAGTCTGCTACCCCTGAATCT | | STEPSEGSAPGTSE | |
| | GGTCCTGGCTCCGAACCTGCTACCTCTGGTTC | | SATPESGPGSEPAT | |
| | CGAAACTCCAGGTACCTCGGAATCTGCGACTC | | SGSETPGTSESATP | |
| | CGGAATCTGGCCCGGGCACGAGCACGGAGCCG | | ESGPGSEPATSGSE | |
| | TCTGAGGGTAGCGCACCAGGTACCAGCACTGA | | TPGTSESATPESGP | |
| | GCCTTCTGAGGGCTCTGCACCGGGTACCTCCA | | GTSTEPSEGSAPGS | |
| | CGGAACCTTCGGAAGGTTCTGCGCCGGGTACC | | PAGSPTSTEEGTSE | |
| | TCCACTGAGCCATCCGAGGGTTCAGCACCAGG | | SATPESGPGSEPAT | |
| | TACTAGCACGGAACCGTCCGAGGGCTCTGCAC | | SGSETPGTSESATP | |
| | CAGGTACGAGCACCGAACCGTCGGAGGGTAGC | | ESGPGSPAGSPTST | |
| | GCTCCAGGTAGCCCAGCGGGCTCTCCGACAAG | | EEGSPAGSPTSTEE | |
| | CACCGAAGAAGGCACCAGCACCGAGCCGTCCG | | GTSTEPSEGSAPGT | |
| | AAGGTTCCGCACCAGGTACAAGCGAGAGCGCG | | SESATPESGPGTSE | |
| | ACTCCTGAATCTGGTCCGGGTAGCGAGCCTGC | | SATPESGPGTSESA | |
| | AACCAGCGGTTCTGAGACGCCGGGCACTTCCG | | TPESGPGSEPATSG | |
| | AATCTGCGACCCCGGAGTCCGGTCCAGGTTCA | | SETPGSEPATSGSE | |
| | GAGCCGGCGACGAGCGGTTCGGAAACGCCGGG | | TPGSPAGSPTSTEE | |
| | TACGTCTGAATCAGCCACGCCGGAGTCTGGTC | | GTSTEPSEGSAPGT | |
| | CGGGTACCTCGACCGAACCAAGCGAAGGTTCG | | STEPSEGSAPGSEP | |
| | GCACCGGGTACTAGCGAGAGCGCAACCCCTGA | | ATSGSETPGTSESA | |
| | AAGCGGTCCGGGCAGCCCGGCAGGTTCTCCAA | | TPESGPGTSTEPSE | |
| | CCAGCACCGAAGAAGGTTCCCCTGCTGGTAGC | | GSAPG | |
| | CCGACCTCTACGGAGGAAGGTAGCCCTGCAGG | | | |
| | TTCCCCAACTTCTACTGAGGAAGGTACTTCTG | | | |
| | AGTCCGCTACCCCAGAAAGCGGTCCTGGTACC | | | |
| | TCCACTGAACCGTCTGAAGGCTCTGCACCAGG | | | |
| | CACTTCTGAGTCTGCTACTCCAGAAAGCGGCC | | | |
| | CAGGTTCTGAACCAGCAACTTCTGGCTCTGAG | | | |
| | ACTCCAGGCACTTCTGAGTCCGCAACGCCTGA | | | |
| | ATCCGGTCCTGGTTCTGAACCAGCTACTTCCG | | | |
| | GCAGCGAAACCCCAGGTACCTCTGAGTCTGCG | | | |
| | ACTCCAGAGTCTGGTCCTGGTACTTCCACTGA | | | |
| | GCCTAGCGAGGGTTCCGCACCAGGTTCTCCGG | | | |
| | CTGGTAGCCCGACCAGCACGGAGGAGGGTACG | | | |
| | TCTGAATCTGCAACGCCGGAATCGGGCCCAGG | | | |
| | TTCGGAGCCTGCAACGTCTGGCAGCGAAACCC | | | |
| | CGGGTACCTCCGAATCTGCTACACCGGAAAGC | | | |
| | GGTCCTGCAGCCCTGCTGGTTCTCCAACCTC | | | |
| | TACCGAGGAGGGTTCACCGGCAGGTAGCCCGA | | | |
| | CTAGCACTGAAGAAGGTACTAGCACGGAGCCG | | | |
| | AGCGAGGGTAGTGCTCCGGGTACGAGCGAGAG | | | |
| | CGCAACGCCAGAGAGCGGTCCAGGCACCAGCG | | | |
| | AATCGGCCACCCCTGAGAGCGGCCCAGGTACT | | | |
| | TCTGAGAGCGCCACTCCTGAATCCGGCCCTGG | | | |
| | TAGCGAGCCGGCAACCTCCGGCTCAGAAACTC | | | |
| | CTGGTTCGGAACCAGCGACCAGCGGTTCTGAA | | | |
| | ACTCCGGGTAGCCCCGGCAGGCAGCCCAACGAG | | | |
| | CACCGAAGAGGGTACCAGCACGGAACCGAGCG | | | |

TABLE 10-continued

DNA and amino acid sequence of AC1278 and AC1476
anti-EpCAM-anti-CD3-XTEN with Release Segment

| Construct Name | DNA Sequence | SEQ ID NO: | Amino Acid Sequence* | SEQ ID NO: |
|---|---|---|---|---|
| | AGGGTTCTGCCCCGGGTACTTCCACCGAACCA<br>TCGGAGGGCTCTGCACCTGGTAGCGAACCTGC<br>GACGTCTGGTTCTGAAACGCCGGGTACCAGCG<br>AAAGCGCTACCCCAGAATCCGGTCCGGGCACT<br>AGCACCGAGCCATCGGAGGGCTCCGCACCAGG<br>T | | | |
| AC1476 | ATGAAGAAAAACATCGCTTTTCTTCTTGCATC<br>TATGTTCGTTTTTTCTATTGCTACAAACGCGT<br>ACGCTGATATTCAGATGACCCAATCGCCGTCG<br>TCCCTGTCAGCTTCAGTCGGTGATCGTGTTAC<br>CATTACCTGTCGCTCAACGAAATCCCTGCTGC<br>ATTCAAACGGTATTACCTATCTGTACTGGTAT<br>CAGCAAAAACCGGGCAAAGCGCCGAAACTGCT<br>GATCTACCAGATGTCGAATCTGGCCAGCGGTG<br>TTCCGTCTCGTTTTAGCTCTAGTGGTTCTGGC<br>ACCGATTTCACCCTGACGATTTCCTCACTGCA<br>ACCGGAAGACTTTGCAACGTATTACTGCGCTC<br>AGAACCTGGAAATCCCGCGTACCTTCGGTCAA<br>GGCACGAAAGTCGAAATTAAAGGTGCAACGCC<br>TCCGGAGACTGGTGCTGAAACTGAGTCCCCGG<br>GCGAGACGACCGGTGGCTCTGCTGAATCCGAA<br>CCACCGGGCGAAGGCCAAGTGCAACTGGTTCA<br>GAGCGGTCCGGGTCTGGTCCAACCGGGTGGCA<br>GTGTGCGTATTTCCTGCGCGGCCTCAGGTTAC<br>ACCTTTACGAACTATGGCATGAATTGGGTGAA<br>ACAGGCCCCGGGTAAAGGCCTGGAATGGATGG<br>GTTGGATCAACACCTACACGGGCGAATCTACC<br>TATGCAGATAGTTTCAAAGGCCGCTTTACCTT<br>CAGCCTGGACACGTCTGCTAGTGCAGCTTATC<br>TGCAGATTAATAGCCTGCGTGCGGAAGATACG<br>GCCGTTTATTACTGTGCGCGCTTTGCAATCAA<br>AGGCGACTACTGGGGCCAAGGCACCCTGCTGA<br>CCGTGTCCTCCGGTGGTGGCGGCAGCGACATC<br>CAAATGACCCAGAGCCCGAGCAGCCTGAGCGC<br>GAGCGTGGGCGACCGTGTTACCATCACCTGCC<br>GTGCGAGCCAAGACATCCGTAACTACCTGAAC<br>TGGTATCAGCAAAAGCGGGTAAAGCGCCGAAA<br>GCTGCTGATCTACTATACCAGCCGTCTGGAGA<br>GCGGCGTGCCGAGCCGTTTCAGCGGTAGCGGT<br>AGCGGTACCGACTACACCCTGACCATTAGCAG<br>CCTGCAGCCGGAAGATTTCGCGACCTACTATT<br>GCCAGCAGGGTAACACCCTGCCGTGGACCTTT<br>GGTCAAGGCACCAAAGTTGAGATTAAAGGCGC<br>CACGCCTCCGGAAACTGGTGCTGAGACGGAAT<br>CCCCTGGTGAAACCACTGGCGGTTCTGCCGAA<br>TCTGAACCGCCTGGTGAAGGCGAGGTGCAGCT<br>GGTTGAAAGCGGTGGCGGTCTGGTGCAACCAG<br>GCGGTAGCCTGCGTCTGAGCTGCGCGGCGAGC<br>GGTTACAGCTTTACCGGTTATACCATGAACTG<br>GGTTCGTCAAGCGCCAGGTAAAGGTCTGGAGT<br>GGGTGGCGCTGATCAACCCGTACAAGGGTGTT<br>AGCACCTATAACCAGAAGTTCAAAGACCGTTT<br>TACCATTAGCGTGGATAAGAGCAAAAACACCG<br>CGTACCTGCAAATGAACAGCCTGCGTGCGGAG<br>GACACCGCTGTGTACTATTGCGCGTAGCGG<br>TTACTATGGCGACAGCGACTGGTATTTTGATG<br>TGTGGGGCCAAGGCACCCTGGTTACCGTGAGC<br>TCCGGCACCGCCGAAGCAGCTAGCGCCTCTGG<br>CCTGTCAGGTCGTTCTGATAACCATTCCCCAC<br>TGGGTCTGGCTGGGTCTCCAGGTAGCCCAGCT<br>GGTAGCCCAACCTCTACCGAAGAAGGTACCTC<br>TGAATCCGCTACTCCAGAATCCGGTCCTGGTA<br>CTAGCACTGAGCCAAGCGAAGGTTCTGCTCCA<br>GGCTCCCCGGCAGGTAGCCCTACCTCTACCGA<br>AGAGGGCACTAGCACCGAACCATCTGAGGGTT<br>CCGCTCCTGGCACCTCCACTGAACCGTCCGAA<br>GGCAGTGCTCCGGGTACTTCGAAAGCGCAAC<br>TCCGGAATCCGGCCCTGGTTCTGAGCCTGCTA<br>CTTCCGGCTCTGAAACTCCAGGTAGCGAGCCA<br>GCGACTTCTGGTTCTGAAACTCCAGGTTCACC<br>GGCGGGTAGCCCGACGAGCACGGAGGAAGGTA<br>CCTCTGAGTCGGCCACTCCTGAGTCCGGTCCG | 478 | MKKNIAFLLASMFV<br>FSIATNAYADIQMT<br>QSPSSLSASVGDRV<br>TITCRSTKSLLHSN<br>GITYLYWYQQKPGK<br>APKLLIYQMSNLAS<br>GVPSRFSSSGSGTD<br>FTLTISSLQPEDFA<br>TYYCAQNLEIPRTF<br>GQGTKVEIKGATPP<br>ETGAETESPGETTG<br>GSAESEPPGEGQVQ<br>LVQSGPGLVQPGGS<br>VRISCAASGYTFTN<br>YGMNWVKQAPGKGL<br>EWMGWINTYTGEST<br>YADSFKGRFTFSLD<br>TSASAAYLQINSLR<br>AEDTAVYYCARFAI<br>KGDYWGQGTLLTVS<br>SGGGGSDIQMTQSP<br>SSLSASVGDRVTIT<br>CRASQDIRNYLNWY<br>QQKPGKAPKLLIYY<br>TSRLESGVPSRFSG<br>SGSGTDYTLTISSL<br>QPEDFATYYCQQGN<br>TLPWTFGQGTKVEI<br>KGATPPETGAETES<br>PGETTGGSAESEPP<br>GEGEVQLVESGGGL<br>VQPGGSLRLSCAAS<br>GYSFTGYTMNWVRQ<br>APGKGLEWVALINP<br>YKGVSTYNQKFKDR<br>FTISVDKSKNTAYL<br>QMNSLRAEDTAVYY<br>CARSGYYGDSDWYF<br>DVWGQGTLVTVSSG<br>TAEAASASGLSGRS<br>DNHSPLGLAGSPGS<br>PAGSPTSTEEGTSE<br>SATPESGPGTSTEP<br>SEGSAPGSPAGSPT<br>STEEGTSTEPSEGS<br>APGTSTEPSEGSAP<br>GTSESATPESGPGS<br>EPATSGSETPGSEP<br>ATSGSETPGSPAGS<br>PTSTEEGTSESATP<br>ESGPGTSTEPSEGS<br>APGTSTEPSEGSAP<br>GSPAGSPTSTEEGT<br>STEPSEGSAPGTST<br>EPSEGSAPGTSESA<br>TPESGPGTSTEPSE<br>GSAPGTSESATPES<br>GPGSEPATSGSETP<br>GTSTEPSEGSAPGT<br>STEPSEGSAPGTSE<br>SATPESGPGTSESA<br>TPESGPSPAGSPT<br>STEEGTSESATPES<br>GPGSEPATSGSETP<br>GTSESATPESGPGT<br>STEPSEGSAPGTST | 480 |

TABLE 10-continued

DNA and amino acid sequence of AC1278 and AC1476
anti-EpCAM-anti-CD3-XTEN with Release Segment

| Construct Name | DNA Sequence | SEQ ID NO: | Amino Acid Sequence* | SEQ ID NO: |
|---|---|---|---|---|
| | GGCACGAGCACCGAGCCGAGCGAGGGTTCAGC CCCGGGTACCAGCACGGAGCCGTCCGAGGGTA GCGCACCGGGTTCTCCGGCGGGCTCCCCTACG TCTACGGAAGAGGGTACGTCCACTGAACCTAG CGAGGGCAGCGCGCCAGGCACCAGCACTGAAC CGAGCGAAGGCAGCGCACCTGGCACTAGCGAG TCTGCGACTCCGGAGAGCGGTCCGGGTACGAG CACGGAACCAAGCGAAGGCAGCGCCCCAGGTA CCTCTGAATCTGCTACCCCAGAATCTGGCCCG GGTTCCGAGCCAGCTACCTCTGGTTCTGAAAC CCCAGGTACTTCCACTGAACCAAGCGAAGGTA GCGCTCCTGGCACTTCTACTGAACCATCCGAA GGTTCCGCTCCTGGTACGTCTGAAAGCGCTAC CCCTGAAAGCGGCCCAGGCACCTCTGAAAGCG CTACTCCTGAGAGCGGTCCAGGCTCTCCAGCA GGTTCTCCAACCTCCACTGAAGAAGGCACCTC TGAGTCTGCTACCCCTGAATCTGGTCCTGGCT CCGAACCTGCTACCTCTGGTTCCGAAACTCCA GGTACCTCGGAATCTGCGACTCCGGAATCTGG CCCGGGCACGAGCACGGAGCCGTCTGAGGGTA GCGCACCAGGTACCAGCACTGAGCCTTCTGAG GGCTCTGCACCGGGTACCTCCACGGAACCTTC GGAAGGTTCTGCGCCGGGTACCTCCACTGAGC CATCCGAGGGTTCAGCACCAGGTACTAGCACG GAACCGTCCGAGGGCTCTGCACCAGGTACGAG CACCGAACCGTCGGAGGGTAGCGCTCCAGGTA GCCCAGCGGGCTCTCCGACAAGCACCGAAGAA GGCACCAGCACCGAGCCGTCCGAAGGTTCCGC ACCAGGTACAAGCGAGAGCGCGACTCCTGAAT CTGGTCCGGGTAGCGAGCCTGCAACCAGCGGT TCTGAGACGCCGGGCACTTCCGAATCTGCGAC CCCGGAGTCCGGTCCAGGTTCAGAGCCGGCGA CGAGCGGTTCGGAAACGCCGGGTACGTCTGAA TCAGCCACGCCGGAGTCTGGTCCGGGTACCTC GACCGAACCAAGCGAAGGTTCGGCACCGGGTA CTAGCGAGAGCGCAACCCCTGAAAGCGGTCCG GGCAGCCCGGCAGGTTCTCCAACCAGCACCGA AGAAGGTTCCCCTGCTGGTAGCCCGACCTCTA CGGAGGAAGGTAGCCCTGCAGGTTCCCCAACT TCTACTGAGGAAGGTACTTCTGAGTCCGCTAC CCCAGAAAGCGGTCCTGGTACCTCCACTGAAC CGTCTGAAGGCTCTGCACCAGGCACTTCTGAG TCTGCTACTCCAGAAAGCGGCCCAGGTTCTGA ACCAGCAACTTCTGGCTCTGAGACTCCAGGCA CTTCTGAGTCCGCAACGCCTGAATCCGGTCCT GGTTCTGAACCAGCTACTTCCGGCAGCGAAAC CCCAGGTACCTCTGAGTCTGCGACTCCAGAGT CTGGTCCTGGTACTTCCACTGAGCCTAGCGAG GGTTCCGCACCAGGTTCTCCGGCTGGTAGCCC GACCAGCACGGAGGAGGGTACGTCTGAATCTG CAACGCCGGAATCGGGCCCAGGTTCGGAGCCT GCAACGTCTGGCAGCGAAACCCCGGGTACCTC CGAATCTGCTACACCGGAAAGCGGTCCTGGCA GCCCTGCTGGTTCTCCAACCTCTACCGAGGAG GGTTCACCGGCAGGTAGCCCGACTAGCACTGA AGAAGGTACTAGCACGGAGCCGAGCGAGGGTA GTGCTCCGGGTACGAGCGAGAGCGCAACGCCA GAGAGCGGTCCAGGCACCAGCGAATCGGCCAC CCCTGAGAGCGGCCCAGGTACTTCTGAGAGCG CCACTCCTGAATCCGGCCCTGGTAGCGAGCCG GCAACCTCCGGCTCAGAAACTCCTGGTTCGGA ACCAGCGACCAGCGGTTCTGAAACTCCGGGTA GCCCGGCAGGCAGCCCAACGAGCACCGAAGAG GGTACCAGCACGGAACCGAGCGAGGGTTCTGC CCCGGGTACTTCCACCGAACCATCGGAGGGCT CTGCACCTGGTAGCGAACCTGCGACGTCTGGT TCTGAAACGCCGGGTACCAGCGAAAGCGCTAC CCCAGAATCCGGTCCGGGCACTAGCACCGAGC CATCGGAGGGCTCCGCACCAGGTCACCATCAT CACCATCAC | | EPSEGSAPGTSTEP SEGSAPGTSTEPSE GSAPGTSTEPSEGS APGTSTEPSEGSAP GSPAGSPTSTEEGT STEPSEGSAPGTSE SATPESGPGSEPAT SGSETPGTSESATP ESGPGSEPATSGSE TPGTSESATPESGP GTSTEPSEGSAPGT SESATPESGPGSPA GSPTSTEEGSPAGS PTSTEEGSPAGSPT STEEGTSESATPES GPGTSTEPSEGSAP GTSESATPESGPGS EPATSGSETPGTSE SATPESGPGSEPAT SGSETPGTSESATP ESGPGTSTEPSEGS APGSPAGSPTSTEE GTSESATPESGPGS EPATSGSETPGTSE SATPESGPGSPAGS PTSTEEGSPAGSPT STEEGTSTEPSEGS APGTSESATPESGP GTSESATPESGPGT SESATPESGPGSEP ATSGSETPGSEPAT SGSETPGSPAGSPT STEEGTSTEPSEGS APGTSTEPSEGSAP GSEPATSGSETPGT SESATPESGPGTST EPSEGSAPGHHHHH H | |

*underlined peptide represents the signal peptide

Example 2: Production of Uncleaved and Cleaved His8-aEpCAM-aCD3-BSRS1-XTEN864 ("His8" Disclosed as SEQ ID NO: 481) from *E. coli* Fermentation Culture 1) Expression and Purification of His(8)-aEpCAM-aCD3-BSRS1-XTEN_AE864 ("His8" Disclosed as SEQ ID NO: 481) from *E. coli* Fermentation Culture The fusion protein AC1278 (MKKNIAFLLASMFVFSI-ATNAYA-His(8)-aEpCAM-aCD3-BSRS1-XTEN_AE864 (SEQ ID NO: 482)) was expressed in Amunix's proprietary *E. coli* AmE098 strain A 10 L fermentation culture was grown at 37° C. and temperature shifted to 26° C. following depletion of the salt feed. During harvest, fermentation whole broth was centrifuged to pellet the cells. The supernatant was collected, and acid flocculation was then used to reduce endotoxin and host cell protein contamination. Using 1 M acetic acid, the supernatant pH was gradually lowered to pH 4.5 and left to incubate at room temperature for 30 minutes. The pH was then raised back to pH 7.5 using 2M NaOH and held overnight at 4° C. On the following day, the supernatant was 0.20 µm filtered using a 3M LifeAssure filter capsule.

Figure 14A:
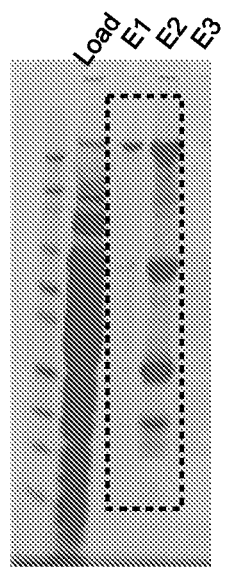
FIG. 14A shows exemplary SDS-PAGE of IMAC capture of AC1278 from fermentation media.

To ensure N-terminal integrity at the His affinity tag, immobilized-metal affinity chromatography was used as the first capture step. Five 10-mL RedisepRf 25G column housings (Teledyne Isco) were packed with 10 mL of ToyoPearl-AF-Chelate 650M resin (TOSOH Biosciences). The columns were sanitized with 0.5M NaOH, thoroughly rinsed with distilled water, and then charged with 0.1M $Ni_2SO_4$, and equilibrated with 5 column volumes (CVs) of equilibration buffer (20 mM Tris, 250 mM NaCl, pH 7.5). Due to Triton X-114's cloud point of 23° C., Triton Wash buffer (20 mM Tris, 100 mM NaCl, 0.1% Triton X-114, pH 7.5) and Wash 2 buffer (20 mM Tris, 100 mM NaCl, pH 7.5) were prepared in advance, stored at 4° C., and kept on ice during use. After column equilibration, the supernatant was loaded to the column. Following 3 CVs of equilibration buffer as chase, the column was washed with 10CVs of cold Triton Wash buffer to lower endotoxin, followed by 10 CVs of cold Wash 2 buffer to remove Triton X-114. Protein was then eluted from the column with 3 CVs of elution buffer (20 mM Tris, 100 mM NaCl, 150 mM imidazole, pH 7.5), and 1 CV fractions (10 mL) were collected. To reduced protein oxidation, 5 mM EDTA was added to each elution. The load, flowthrough, and elution's were analyzed by non-reducing 4-12% Bis-Tris SDS-PAGE and Coomassie staining. Based on the gel, elution CV1 and CV2 were saved for further processing. (FIG. 14A)

Figure 14B:
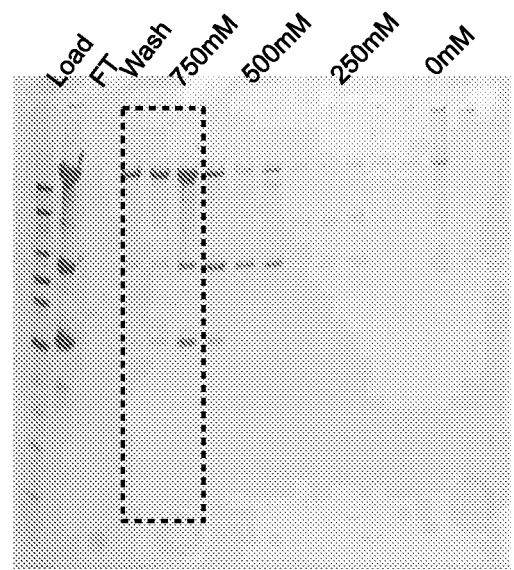
FIG. 14B shows SDS-PAGE analysis of fractions in HIC polishing step.

Hydrophobic interaction chromatography (HIC) was chosen as the subsequent polishing step. Two 20-mL RedisepRf 25G column housings (Teledyne Isco) were packed with 20 mL of Toyopearl-Phenyl-650M resin (TOSOH Biosciences). The columns were sanitized with 0.5M NaOH, thoroughly rinsed with distilled water, and equilibrated with 5 CVs of Buffer A (20 mM Tris, 1 M $(NH_4)_2SO_4$, pH 7.5). Elution buffers at 75% Buffer A, 50% Buffer A, and 25% Buffer A were prepared in advance by mixing appropriate volumes of Buffer A and Buffer B (20 mM Tris, pH 7.5). IMAC elutions CV1 and 2 were pooled together from the previous column step, and ammonium sulfate was added to a final concentration of 1M before loading to the pre-equilibrated Phenyl columns. After loading and chasing with 3 CVs of Buffer A, the column was eluted with 3 CVs each of 75% Buffer A, 50% Buffer A, 25% Buffer A, and 0% Buffer A. The load, flowthrough, and elutions were analyzed by non-reducing 4-12% Bis-Tris SDS-PAGE and Coomassie staining. Based on the gel, wash and elutions CV1-2 at 750 mM $(NH_4)_2SO_4$ (boxed) were pooled for further processing (FIG. 14B).

Figure 14C:
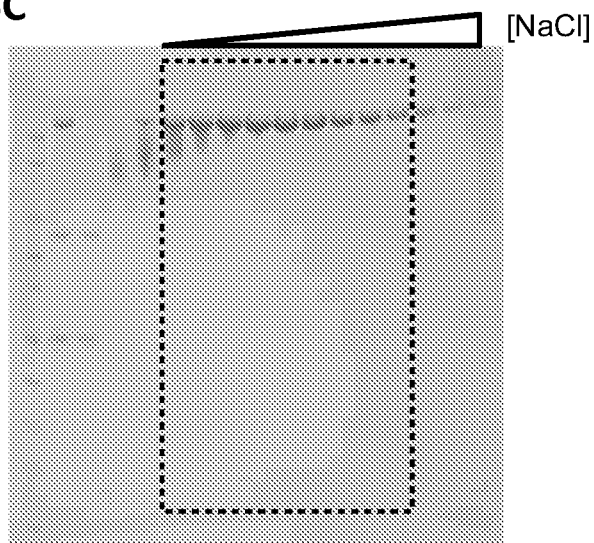
FIG. 14C shows SDS-PAGE analysis of fractions in ImpRes-Q polishing step.

To ensure C-terminal integrity of XTEN and to further lower endotoxin, anion exchange chromatography was chosen as the final polishing step. A XK16 column housing on AKTApurifier was packed with 5 mL of Capto Q Impress resin (GE Healthcare), sanitized with 0.5M NaOH, thoroughly rinsed with distilled water, stripped with 2 CVs of Buffer B (20 mM Tris, 500 mM NaCl, pH 7.5), and equilibrated with 5 CVs of Buffer A (20 mM Tris pH 7.5). The HIC elution pool was diluted 4 fold before loading to the column. The column was then washed with 3 CVs of 30% Buffer B and eluted in a gradient of 30% to 70% Buffer B over 15 CVs. Elutions were collected in ½ CV (2.5 mL) fractions. The load, flowthrough, and elutions were then analyzed by non-reducing SDS-PAGE and Coomassie staining to determine fractions to pool for formulation (FIG. 14C).

2) Formulation and Characterization

Figure 15A:
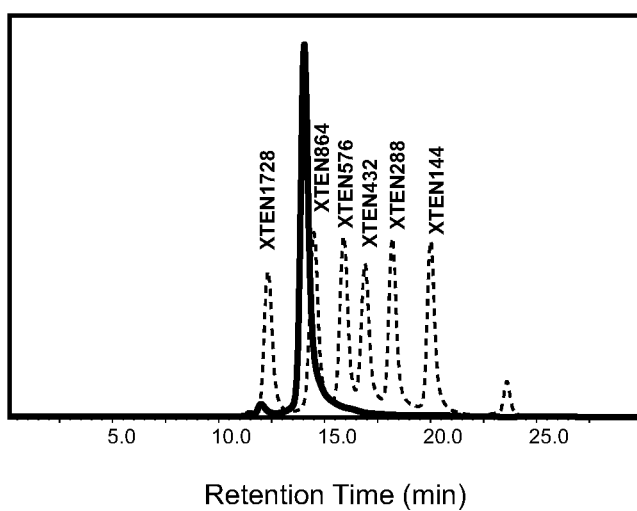
FIG. 15A shows the lot release analytical SEC chromatography of uncleaved AC1278 (in solid line) against XTEN length standard (in dashed line)
Figure 15B:
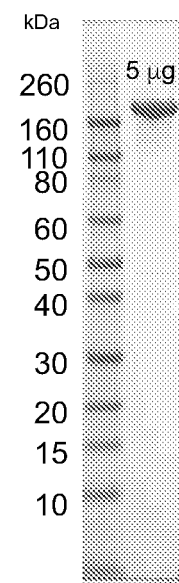
FIG. 15B shows the lot release SDS-PAGE of uncleaved AC1278.

Desired elution fractions (boxed in FIG. 14C) were concentrated and buffer exchanged into 50 mM Tris, 150 mM NaCl, pH 7.5. Formulated product was 0.2 µm sterile filtered. Lot release to determine product quality involved size exclusion chromatography analysis and SDS-PAGE analysis. For SEC analysis, 10 µg of formulated product was injected to an analytical SEC column, confirming >95% monomeric product. (FIG. 15A). SDS-PAGE analysis was conducted by loading 5 µg of formulated product to a 4-12% Bis-Tris gel and staining with Coomassie Blue. The product purity was >90% (FIG. 15B).

3) Enzyme Activation and Storage

Recombinant mouse MMP-9 was supplied as zymogen from R&D Systems and required activation by 4-aminophenylmercuric acetate (APMA). APMA was first dissolved in 0.1M NaOH to a final concentration of 10 mM before the pH was readjusted to neutral using 0.1N HCl. Further dilution of the APMA stock to 2.5 mM was done in 50 mM Tris, 150 mM NaCl, 10 mM $CaCl_2$, pH 7.5. To activate pro-MMP, 1 mM APMA and 100 ug/mL of pro-MMP-9 were incubated at 37° C. for 3 hours. Activated enzyme added to a final concentration of 50% glycerol could then be stored at −20° C. for several weeks.

4) MMP-9 Digestion of His(8)-aEpCAM-aCD3-BSRS1-XTEN864 ("His(8)" Disclosed as SEQ ID NO: 481)

Figure 16A:
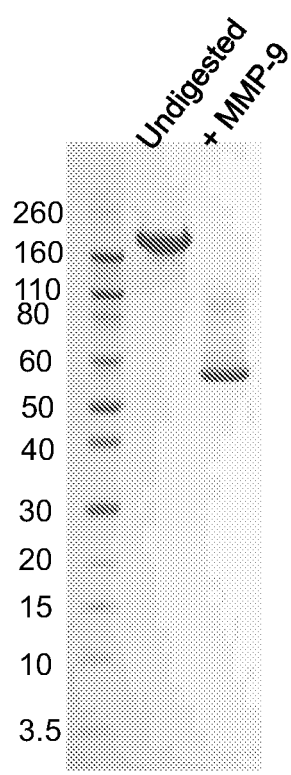
FIG. 16A shows SDS-PAGE analysis of MMP-9 digestion reaction mixture.

To produce cleaved aEpCAM-aCD3 ProTIA-A, 9.12 mg of formulated His(8)-aEpCAM-aCD3-BSRS1-XTEN864 (ProTIA-X) ("His(8)" disclosed as SEQ ID NO: 481) was incubated for 2 hours at 37° C. in a reaction mixture containing 10 mM $CaCl_2$ and a 1:2237 enzyme-to-substrate molar ratio of active recombinant mouse MMP-9 (R&D Systems). To confirm specific digestion at BSRS1, 5 µg of undigested and MMP-9 digested product were run on 4-12% Bis-Tris SDS-PAGE, followed by staining by Coomasie Blue. Use of Coomassie Blue staining allowed visualization of the full-length His8-aEpCAM-aCD3-BSRS1-XTEN864 (ProTIA-X) ("His8" disclosed as SEQ ID NO: 481) before MMP-9 digestion and the His8-aEpCAM-aCD3 cleaved fragment (ProTIA-A) ("His8" disclosed as SEQ ID NO: 481) after MMP-9 digestion (FIG. 16A).

Figure 16B:
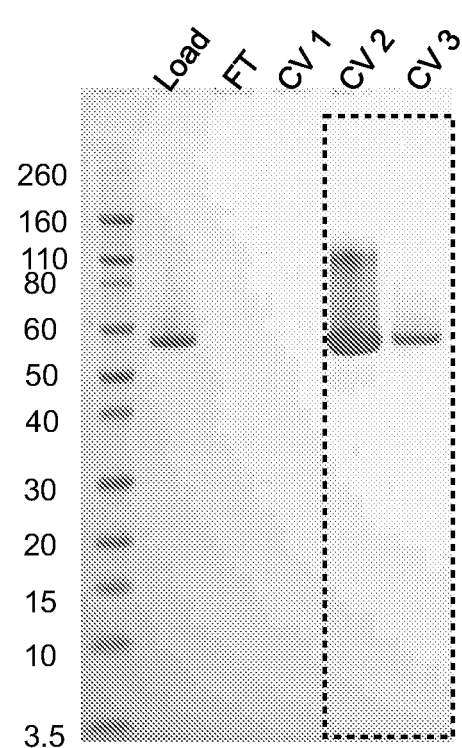
FIG. 16B show SDS-PAGE analysis of IMAC purification of MMP-9 digestion mixture to remove cleaved XTEN segment.

5) Purification of Cleaved His(8)-aEpCAM-aCD3 ProTIA-A ("His(8)" Disclosed as SEQ ID NO: 481) Following MMP-9 Digestion Following confirmation of MMP-9 digestion at BSRS1, immobilized-metal affinity chromatography was used to remove MMP-9. A 5-mL polypropylene column housing (ThermoScientific) was packed with 2 mL of ToyoPearl-AF-Chelate 650M resin (TOSOH Biosciences). The column was equilibrated with 5 CVs of equilibration buffer (20 mM Tris, 250 mM NaCl, pH 7.5). The digestion mixture was then loaded to the column. After loading and chasing with 1 CV of equilibration buffer, the column was washed with 3 CVs of equilibration buffer. Protein was eluted from the column with 3 CVs of elution buffer (20 mM Tris, 100 mM NaCl, 150 mM imidazole, pH 7.5), and 1 CV fractions (2 mL) were collected. The load, flow-through, and elutions were analyzed by non-reducing 4-12% Bis-Tris SDS-PAGE and Coomassie straining to determine elutions containing Pro-TIA-A (FIG. 16B).

6) Formulation and Characterization of Cleaved His(8)-aEpCAM-aCD3 ("His(8)" Disclosed as SEQ ID NO: 481)

Figure 17A:
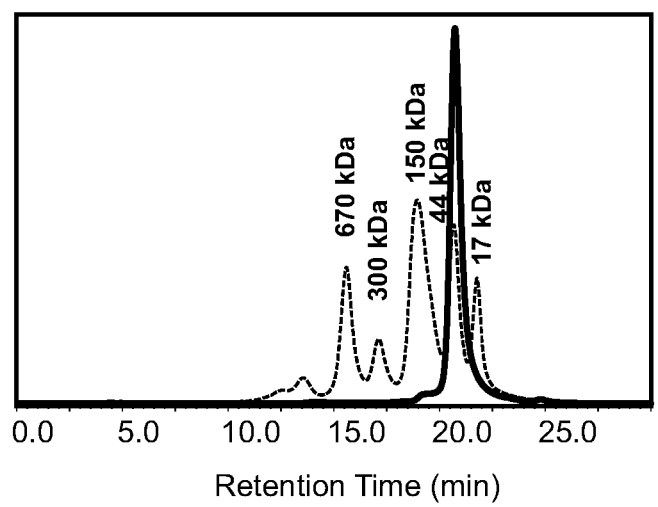
FIG. 17A shows the lot release analytical SEC chromatography of cleaved AC1278 (in solid line) against globular protein standard (in dashed line)
Figure 17B:
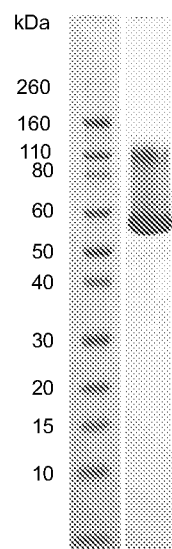
FIG. 17B shows the lot release SDS-PAGE of cleaved AC1278.

Desired elutions (boxed in FIG. 16B) were concentrated and buffer exchanged into 50 mM Tris, 150 mM NaCl, pH 7.5. Lot release to determine product quality involved size exclusion chromatography analysis and SDS-PAGE analysis. For SEC analysis, 10 µg of product was injected to an analytical SEC column, confirming >95% monomeric product (FIG. 17A). For SDS-PAGE analysis, 5 µg of product was run on a 4-12% Bis-Tris gel, confirming >90% product purity (FIG. 17B).

Figure 18A:
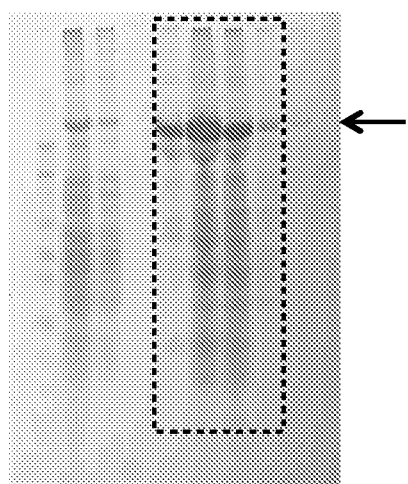
FIG. 18A shows exemplary SDS-PAGE of IMAC capture of AC1476 from fermentation media.

Example 3: Production of Uncleaved and Cleaved AC1476 aEpCAM-aCD3-BSRS1-XTEN_AE864-His(6) ("His(6)" Disclosed as SEQ ID NO: 483) from *E. coli* Fermentation Culture 1) Expression and Purification of AC1476 aEpCAM-aCD3-BSRS1-XTEN_AE864-His(6) ("His(6)" Disclosed as SEQ ID NO: 483) from *E. coli* Fermentation Culture The fusion protein AC1476 (MKKNIAFLLASMFVFSI-ATNAYA-aEpCAM-aCD3-BSRS1-XTEN_AE864-His(6) (SEQ ID NO: 484; "His(6)" disclosed as SEQ ID NO: 483)) was expressed in Amunix's proprietary *E. coli* AmE097 strain. A 10 L fermentation culture was grown at 37° C. and temperature shifted to 28° C. after depletion of the salt feed. During harvest, fermentation whole broth was centrifuged to pellet the cells. The supernatant was 0.20 µm filtered using a 3M LifeAssure filter capsule. A XK50 housing column was packed with 100 mL of Toyopearl-AF-Chelate-650M resin (TOSOH Biosciences) and connected to a peristaltic pump at 4° C. The column was sanitized with 0.5M NaOH, thoroughly rinsed with distilled water, charged with 0.1M NiSO$_4$, and equilibrated with 5 CVs of equilibration buffer (20 mM Tris, 250 mM NaCl, pH 7.5). After column equilibration, the supernatant was loaded to the column, followed by Triton Wash, Wash 2, and elution similar to the process described above in Example 2-1. Elutions were collected in ¼ CV (25 mL) fractions and EDTA was added to a final concentration of 5 mM to chelate free nickel. The load, flowthrough, and elutions were analyzed by non-reducing 4-12% Bis-Tris SDS-PAGE and Coomassie staining. Based on the gel, elutions 2-5 (boxed) were saved for further processing. (FIG. 18A)

Figure 18B:
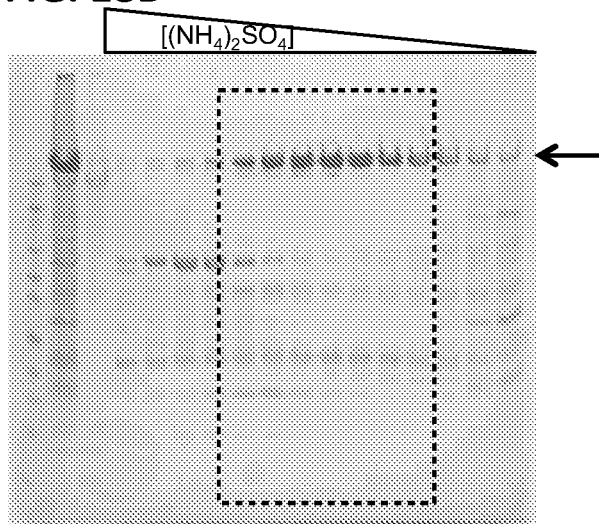
FIG. 18B shows SDS-PAGE analysis of fractions in HIC polishing step.

Hydrophobic interaction chromatography (HIC) was chosen as the subsequent polishing step. A XK24 housing column on AKTApurifier was packed with 50 mL of Toyopearl-Phenyl-650M resin (TOSOH Biosciences). The column was sanitized with 0.5M NaOH, thoroughly rinsed with distilled water, and equilibrated with 5 CVs of Buffer A (20 mM Tris, 1M (NH$_4$)$_2$SO$_4$, pH 7.5). Desired IMAC elutions were pooled together from the previous column step, and ammonium sulfate was added to a final concentration of 1M before loading to the column. Elutions were collected in ½ CV (25 mL) fractions in a gradient from 100% to 50% Buffer A over 10 CVs. The load, flowthrough, and elutions were analyzed by non-reducing 4-12% Bis-Tris SDS-PAGE and Coomassie staining. Based on the gel, elutions boxed were pooled for further processing (FIG. 18B).

Figure 18C:
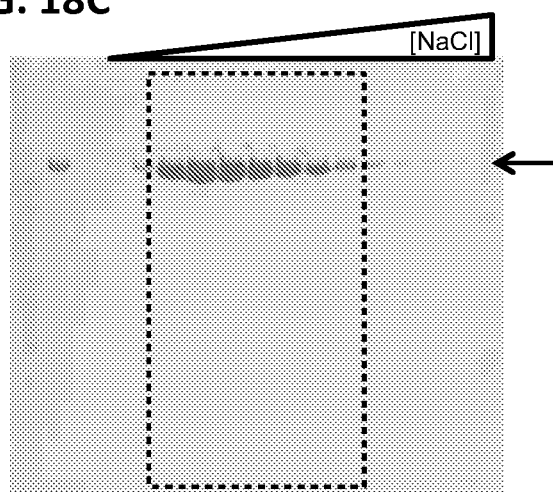
FIG. 18C shows SDS-PAGE analysis of fractions in ImpRes-Q polishing step.

Anion exchange chromatography was chosen as the final polishing step. A XK24 housing column was packed with 30 mL Capto Q Impress resin (GE Healthcare), sanitized with 0.5M NaOH, thoroughly rinsed with distilled water, stripped with 2 CVs of Buffer B (20 mM Tris, 500 mM NaCl, pH 7.5), and equilibrated with 5 CVs of Buffer A (20 mM Tris, pH 7.5). The elution pool was buffer exchanged through a Pellicon XL Ultrafiltration module Biomax 10 kDa into 20 mM Tris pH 7.5 until the permeate had a conductivity of 8 ms/cm. The permeate was loaded to the Capto Q Impress column, and the column was then washed with 3 CVs of 10% and 20% Buffer B. Elutions were collected in ¼ CV (7.5 mL) fractions in a gradient from 20% to 70% Buffer B over 10 CVs. The load, flowthrough, and elutions were analyzed by non-reducing 4-12% Bis-Tris SDS-PAGE and Coomassie staining. Based on the gel, selected elutions (boxed) were pooled for formulation (FIG. 18C).

2) Formulation and Characterization of aEpCAM-aCD3-BSRS1-XTEN864-His(6) ("His(6)" Disclosed as SEQ ID NO: 483)

Figure 19A:
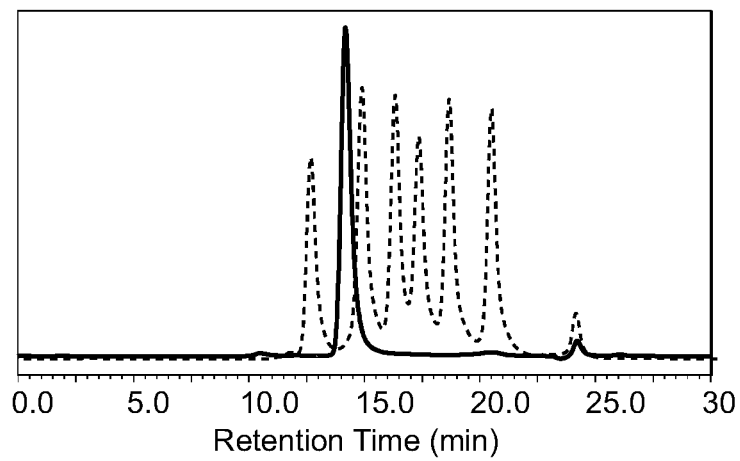
FIG. 19A shows the lot release analytical SEC chromatography of uncleaved AC1476 (in solid line) against XTEN length standard (in dashed line)
Figure 19B:
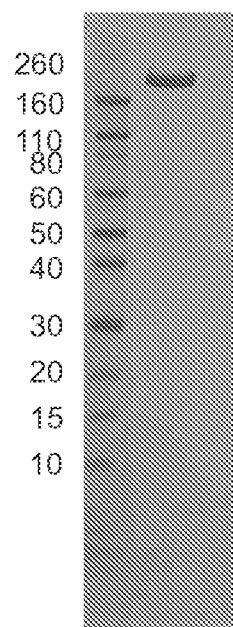
FIG. 19B shows the lot release SDS-PAGE of uncleaved AC1476 with Coomassie staining.
Figure 19C:
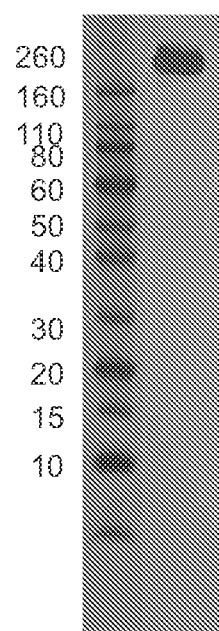
FIG. 19C shows the lot release SDS-PAGE of uncleaved AC1476 with silver staining.

Desired elutions were concentrated and buffer exchanged into 50 mM Tris, 150 mM NaCl, pH 7.5. Lot release to determine product quality was performed following protocol established in Example 2 for SEC analysis (FIG. 19A) and SDS-PAGE (FIG. 19B). Additionally, 2 µg was loaded to a 4-12% Bis-Tris non-reducing SDS-PAGE gel, with subsequent silver staining (FIG. 19C). The results of SEC were also used to determine the apparent molecular weight and apparent molecular weight factor (relative to actual molecular weight) and the hydrodynamic radius of the aEpCAM-aCD3-BSRS1-XTEN864-His(6) ("His(6)" disclosed as SEQ ID NO: 483). The apparent molecular weight determined was 1.7 MDa, which would result in an apparent molecular weight factor of 12.3 and a calculated hydrodynamic radius of 10.8 nm.

Figure 20A:
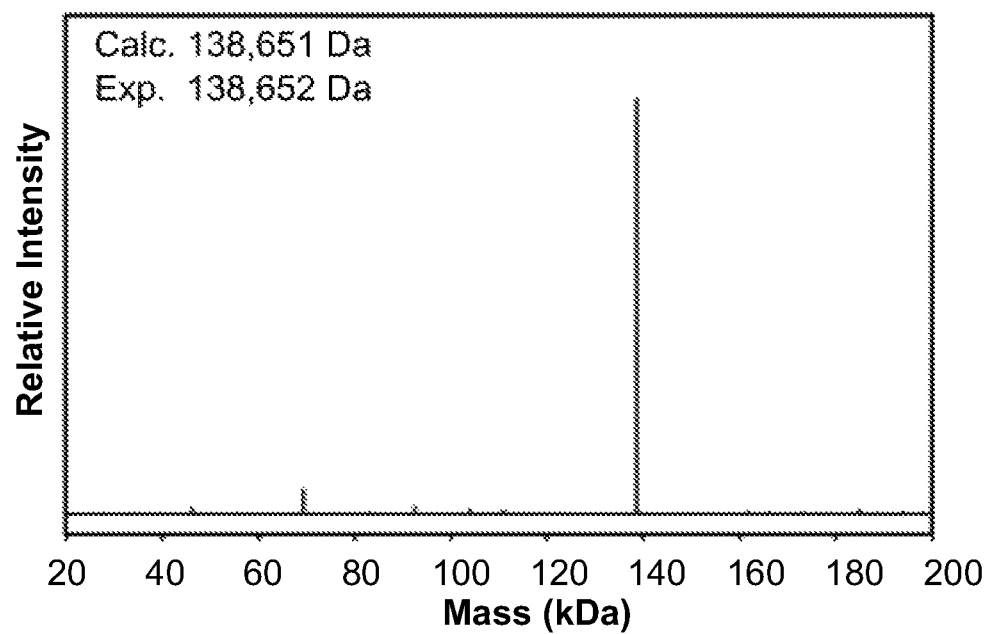
FIG. 20A shows the lot release ESI-MS of uncleaved AC1476.
Figure 20B:
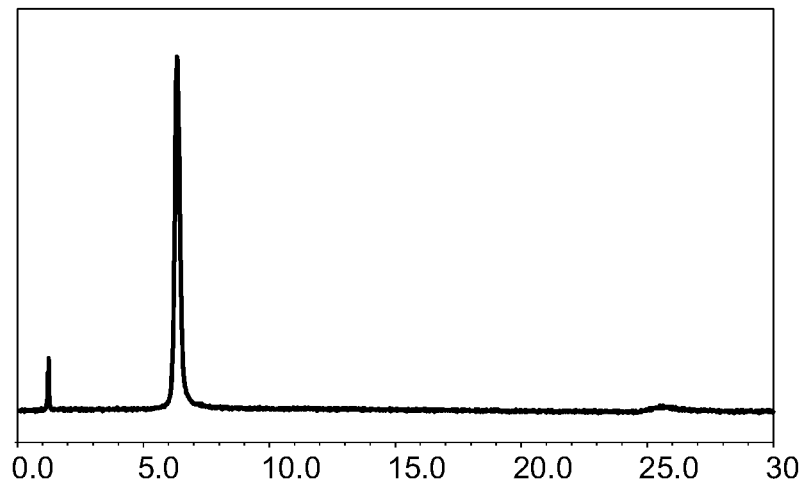
FIG. 20B shows the lot release cation exchange chromatography of uncleaved AC1476.

To further prove the identity of the molecule, electrospray ionization mass spectrometry (ESI-MS) was performed and the experimental mass was determined to be 138,652 Da, with ΔMass of +1 Da when compared to theoretical molecular weight of 138,651 Da (FIG. 20A). For analytical cation exchange chromatography, 10 µg of sample was loaded onto Agilent Bio SCX NP3 with mobile phase A 20 mM sodium acetate, pH 4.5 and mobile phase B 20 mM sodium acetate, 1 M sodium chloride, pH 4.5. A linear gradient of 0-100% B was applied during the course of 20 minutes and only one single major peak was detected (FIG. 20B).

4) MMP-9 Digestion of aEpCAM-aCD3-BSRS1-XTEN864-His(6) ("His(6)" Disclosed as SEQ ID NO: 483)

Figure 21A:
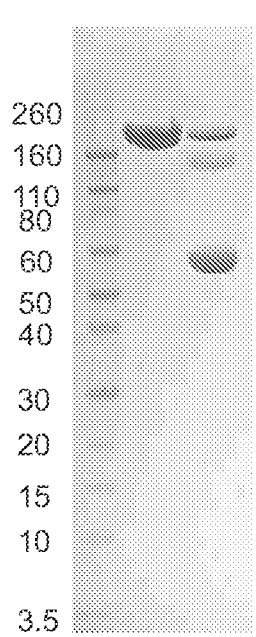
FIG. 21A shows the SDS-PAGE analysis of MMP-9 digestion reaction mixture.

Following MMP-9 activation and digestion protocol described in Example 2, 20 mg of aEpCAM-aCD3-BSRS1-XTEN864-His(6) (ProTIA-X) ("His(6)" disclosed as SEQ ID NO: 483) was digested, however using only 1:6000 molar enzyme-to-substrate molar ratio of active recombinant mouse MMP-9. Undigested and digested products were analyzed by SDS-PAGE (FIG. 21A).

Figure 21B:
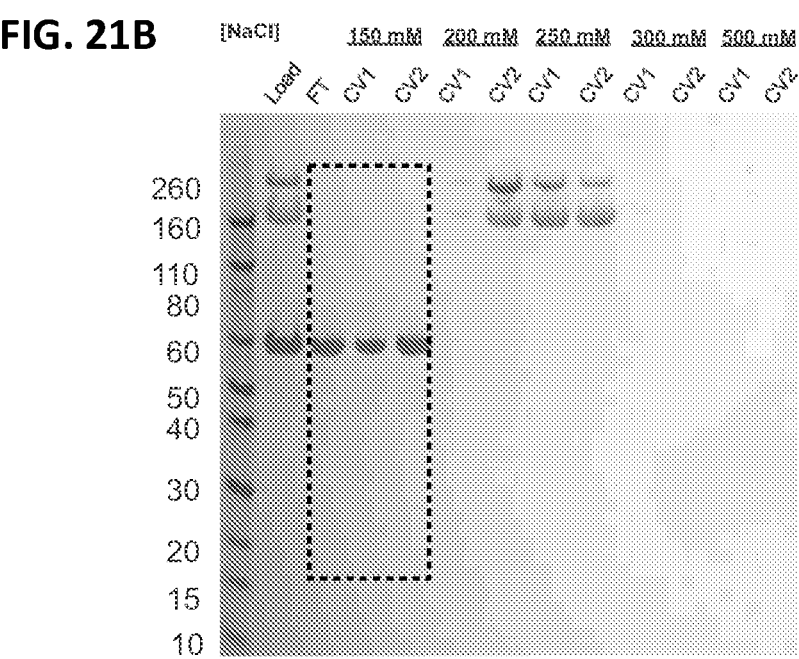
FIG. 21B shows the SDS-PAGE analysis of anion exchange fractions of MMP-9 digestion mixture to remove uncleaved substrate, as well as cleaved XTEN segment.

5) Purification of Cleaved aEpCAM-aCD3-BSRS1-XTEN864-His(6) ("His(6)" Disclosed as SEQ ID NO: 483) Following MMP-9 Digestion Following confirmation of MMP-9 digestion at BSRS1, anion exchange chromatography was used to remove cleaved free XTEN and uncleaved ProTIA-X. Two 5-ml polypropylene column housings (ThermoScientific) were packed with 3 mL each of MacroCap Q resin (GE Healthcare), sanitized with CIP (0.5M NaOH, 1M NaCl), thoroughly rinsed with distilled water, stripped with 2 CVs of Buffer B (20 mM Tris, 500 mM NaCl, PH 7.5), and equilibrated with 5 CVs of Buffer A (20 mM Tris, pH 7.5). The digestion mixture was loaded to the column. After loading and chasing with 1 CV of Buffer A, the column was eluted with 2 CVs each of 150 mM, 200 mM, 250 mM, 300 mM, and 500 mM NaCl. The load, flowthrough, and elutions were analyzed by 4-12% Bis-Tris SDS-PAGE and Coomassie straining to determine fractions containing Pro-TIA-A (FIG. 21B).

Figure 22A:
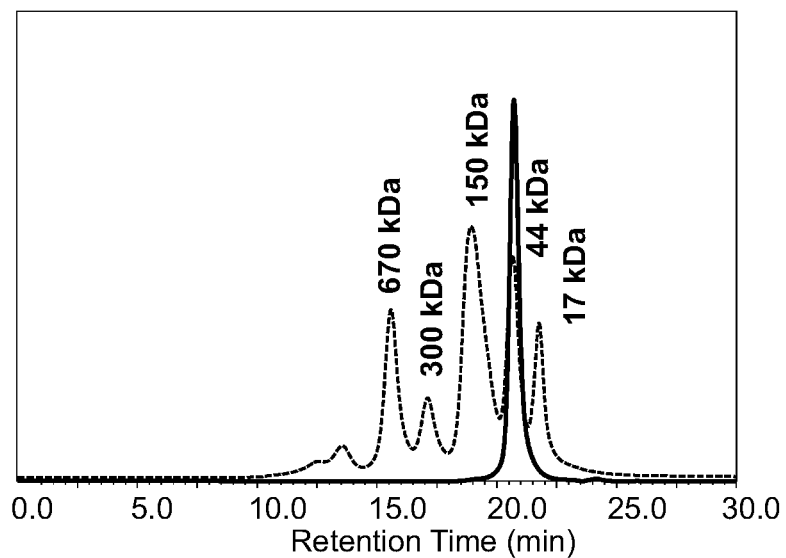
FIG. 22A shows the lot release analytical SEC of cleaved AC1476 (in solid line) against globular protein standard (in dashed line)
Figure 22B:
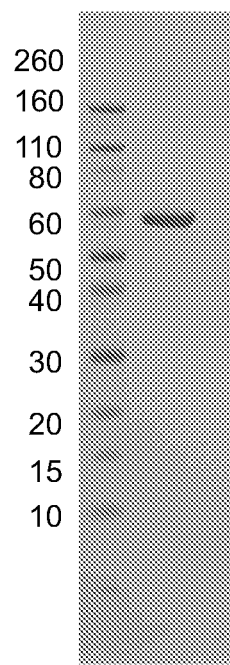
FIG. 22B shows the lot release SDS-PAGE of cleaved AC1476 with Coomassie staining.
Figure 22C:
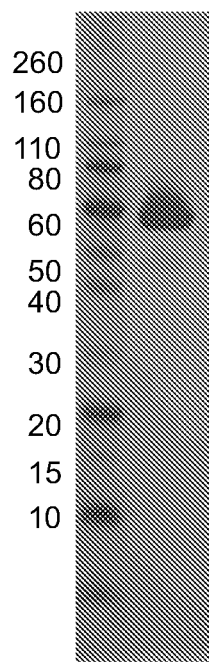
FIG. 22C shows the lot release SDS-PAGE of cleaved AC1476 with silver staining.

6) Formulation and characterization of cleaved aEpCAM-aCD3 Desired ProTIA-A fractions were concentrated and buffer exchanged into 50 mM Tris, 150 mM NaCl, pH 7.5. Lot release to determine product quality was performed following protocol established in Example 2 for SEC analysis (FIG. 22A) and SDS-PAGE (FIG. 22B). Additionally, 2 μg was loaded to a 4-12% Bis-Tris non-reducing SDS-PAGE gel, with subsequent silver staining (FIG. 22C). The results of SEC were also used to determine the apparent molecular weight and apparent molecular weight factor (relative to actual molecular weight) and the calculated hydrodynamic radius of the aEpCAM-aCD3. The apparent molecular weight determined was 39.8 kDa (the latter being about 23-fold less than that of the intact construct, above), which would give apparent molecular weight factor of 0.7 (the latter being about 17-fold less than that of the intact construct, above) and a hydrodynamic radius of 2.3 nm (the latter being about 5-fold less than that of the intact construct, above).

Figure 23A:
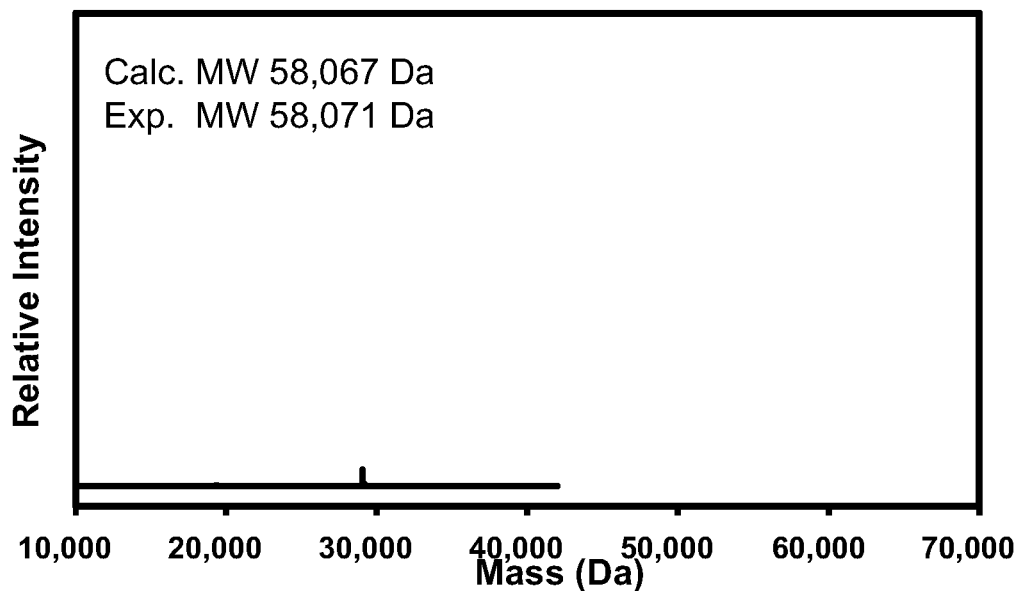
FIG. 23A shows the lot release ESI-MS of cleaved AC1476.
Figure 23B:
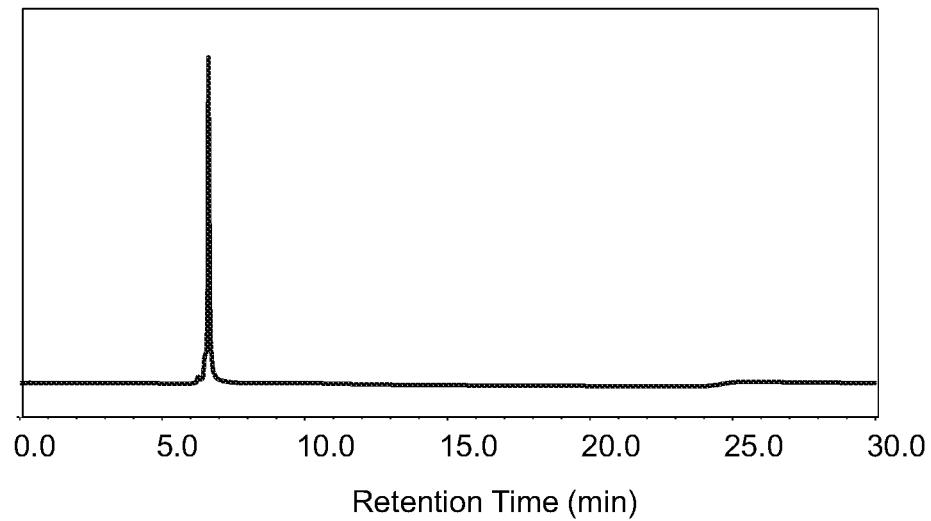
FIG. 23B shows the lot release cation exchange chromatography of cleaved AC1476.

To further prove the identity of the molecule, electrospray ionization mass spectrometry (ESI-MS) was performed and the experimental mass was determined to be 58,071 Da, with ΔMass of +4 Da when compared to theoretical molecular weight of 58,067 Da (FIG. 23A). Analytical cation exchange chromatography (FIG. 23B) using a protocol previously described in 2) also confirmed the homogeneity of the sample.

Example 4: Epcam Binding Assays of Anti-EpCAM×Anti-CD3 Protease Triggered Immune Activator (ProTIA) Composition The binding capability of anti-EpCAM×anti-CD3 ProTIA composition was verified with an EpCAM/peroxidase-conjugated protein-L sandwich ELISA. In the ELISA binding assay, recombinant human EpCAM (rhEpCAM) (Sino BiologicalR&D Systems cat #10694-H08H960-EP-50) was coated on a 96-well, flat-bottomed plate at a concentration of 0.1 microg/100 microL. After overnight incubation at 4° C., the assay plate was washed and blocked with 3% bovine serum albumin (BSA) for 1 h at room temperature. The plate was washed again followed by the introduction of a dose range of non-cleavable anti-EpCAM×anti-CD3 ProTIA (i.e., a ProTIA without the release segment cleavage sequence and AC1484, a ProTIA chimeric polypeptide assembly composition) and protease-treated and protease-untreated anti-EpCAM×anti-CD3 ProTIA (e.g. AC1476). The dose range utilized for non-cleavable and protease-treated and untreated ProTIA was 0.0006 to 5 nM, achieved with a 1:6 fold serial dilution scheme from a starting concentration of 5 nM. The plate was allowed to incubate with shaking for 1 h at room temperature to allow the non-cleavable, protease-cleaved and uncleaved ProTIA to bind to the rhEpCAM coated on the plate. Unbound components were removed with a wash step and a peroxidase-conjugated protein L (PierceThermoFisher Scientific cat #32420) was added.

After an appropriate incubation period that allowed protein-L to bind to the kappa light of the scFvs, any unbound reagent was removed by a wash step followed by the addition of tetramethylbenzidine (TMB) substrate to each well. TMB is a chromogenic substrate of peroxidase. After desired color intensity was reached, 0.2 N sulfuric acid was added to stop the reaction and absorbance (OD) was measured at 450 nm using a spectrophotometer. The intensity of the color is proportional to the concentration of non-cleavable, protease-treated and untreated anti-EpCAM×anti-CD3 ProTIA captured by the rhEpCAM/protein-L sandwich ELISA. The intensity of the color produced (measured OD) was plotted against protein concentration; and the concentration of non-cleavable, protease-cleaved and uncleaved anti-EpCAM×anti-CD3 ProTIA that gave half-maximal response ($EC_{50}$) was derived with a 4-parameter logistic regression equation using GraphPad prism software.

Figure 24:
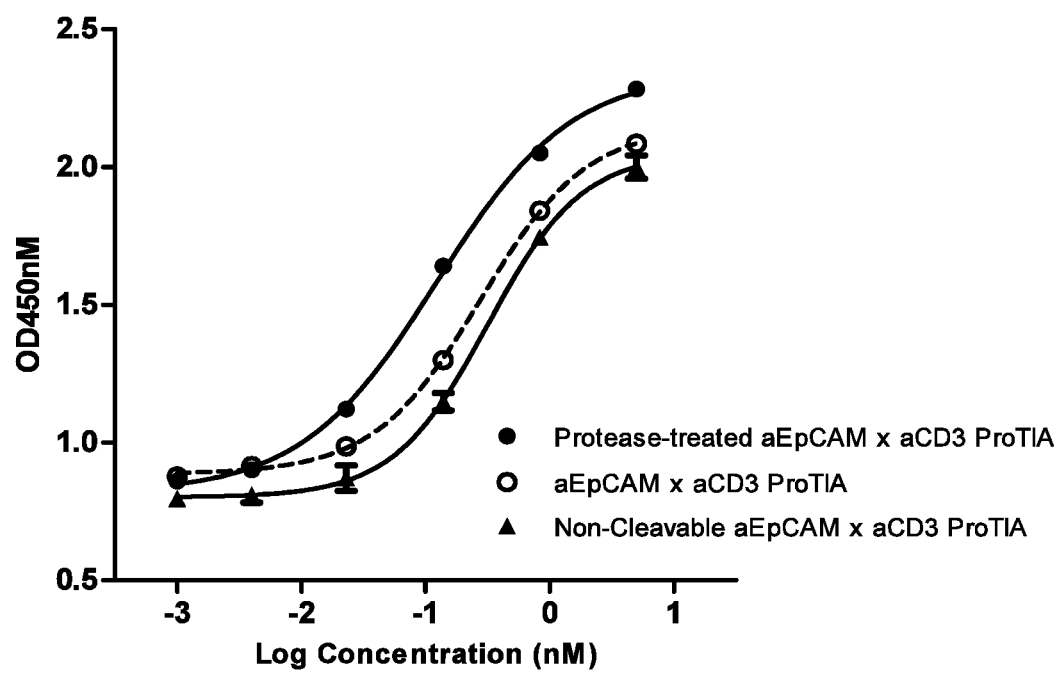
FIG. 24 shows binding of protease-treated and untreated anti-EpCAM×anti-CD3 ProTIA for its ligand, as described in Example 4.

As shown in FIG. 24, the non-cleavable anti-EpCAM×anti-CD3 ProTIA has a binding activity similar to that of protease-untreated anti-EpCAM×anti-CD3 bispecific ProTIA molecule each bearing an $EC_{50}$ of 320 nMpM and 280 nMpM respectively. The protease-treated ProTIA has the strongest binding activity at $EC_{50}$ of 120 nMpM for the rhEpCAM ligand compared to the intact protease-untreated bispecific molecule or the non-cleavable ProTIA molecule. The data suggest that the presence of XTEN864 hindered the binding of the anti-EpCAM moiety for its ligand by at least 2.3-fold.

Example 5: Cell Binding Assessed by Flow Cytometry

Bispecific binding of the anti-EpCAM×anti-CD3 ProTIA composition is also evaluated by fluorescence-activated cell sorting (FACS)-based assays utilizing CD3 positive human Jurkat cells and EpCAM positive human cells selected from SW480, HCT-116, Kato III, MDA-MB-453, MCF-7, MT3, SK-Br-3, SK-OV-3, OVCAR-3 and PC3. $CD3^+$ and $EpCAM^+$ cells are incubated with a dose range of untreated anti-EpCAM×anti-CD3 ProTIA, protease-treated anti-EpCAM×anti-CD3 ProTIA, and anti-CD3 scFv and anti-EpCAM scFv positive controls for 30 min at 4° C. in FACS buffer containing PBS with 1% BSA and 0.05% sodium azide. After several washes in FACS buffer to remove unbound test material, cells are incubated with FITC-conjugated anti-His tag antibody (Abcam cat #ab1206) for 30 min at 4° C. Unbound FITC-conjugated antibody is removed by several washes with FACS buffer and cells resuspended in FACS buffer for acquisition on a FACS Calibur flow cytometer (Becton Dickerson) or equivalent instrument. All flow cytometry data are analyzed with FlowJo software (FlowJo LLC) or equivalent.

While anti-EpCAM scFv is not expected to bind to Jurkat cells, anti-CD3 scFv, untreated anti-EpCAM×anti-CD3 ProTIA and protease-treated anti-EpCAM×anti-CD3 ProTIA are all expected to bind to Jurkat cells as indicated by an increase in fluorescence intensity when compared to Jurkat cells incubated with FITC-conjugated anti-His tag antibody alone. Similarly, anti-EpCAM scFv, protease-treated and untreated anti-EpCAM×anti-CD3 ProTIA are all expected to bind to EpCAM positive cells, while anti-CD3 scFv is not expected to bind to EpCAM positive cells. It is expected that these data will reflect the bispecific binding ability of the anti-EpCAM×anti-CD3 ProTIA composition to recognize both the CD3 and EpCAM antigen expressed respectively on Jurkat and the panel of EpCAM expressing human cell lines. Furthermore, due to the XTEN polymer providing some interference in surface binding, the untreated anti-EpCAM×anti-CD3 ProTIA is expected to bind at a lower affinity than the protease-treated ProTIA for both the CD3 and EpCAM antigens.

Example 6: Cytotoxicity Assays of Anti-EpCAM×Anti-CD3 Protease Triggered Immune Activator (ProTIA) Composition Redirected cellular cytotoxicity of anti-EpCAM×anti-CD3 ProTIA compositions were assessed by using human peripheral blood mononuclear cells (PBMC) as effectors and EpCAM positive human carcinoma cells such as SW480 colon cells (or selected from HCT-116, Kato III, NCI-N87, MKN45, MDA-MB-231, MDA-MB-453, MCF-7, MT3, SK-Br-3, SK-OV-3, OVCAR3 and PC3) as targets. PBMC were isolated from screened, healthy donors by ficoll density gradient centrifugation from either whole blood or from lymphocyte-enriched buffy coat preparations obtained from local blood banks or Bioreclamation IVT. PBMC were resuspended and cultured at appropriate cell density as discussed below in RPMI-1640/10% FCS/25 mmol/mL HEPES at 37° C. in a 5% $CO_2$ humidified incubator until use. Three different types of cytotoxicity assays are used for the determination of the cytolytic activity of non-cleavable anti-EpCAM×anti-CD3 composition (e.g. AC1484), protease-treated and untreated anti-EpCAM×anti-CD3 cleavable ProTIA compositions (e.g. AC1278 & AC1476), namely lactate dehydrogenase (LDH) release assay, caspase 3/7 assay and FACS-based analysis.

As a non-radioactive alternative to $^{51}Cr$ release cytotoxicity assay, the LDH release assay quantitatively measures the stable cytosolic enzyme LDH that is released upon cell lysis in much the same way as $^{51}Cr$ is released in radioactive assays. Released LDH in culture supernatants is measured by an enzymatic assay that converts a tetrazolium salt into a red formazan product; the amount of color formed being proportional to the number of lysed cells.

The cytotoxic performance of the protease-treated and untreated anti-EpCAM×anti-CD3 ProTIA compositions in SW480 were thus analyzed as follows: cell density of SW480 and PBMC was first adjusted to $2.5 \times 10^5$ cells/mL and $1 \times 10^6$ cells/mL respectively in assay medium comprised of phenol red-free RPMI and 5% FCS. (Phenol red-free medium and 5% FCS were used to minimize background absorbance with the use of Promega CytoTox 96 Non-radioactive Cytotoxicity Assay kit (cat #G1780)). To achieve an effector to target ratio of 5:1, 100 microL aliquots of PBMC were co-cultured with 80 microL aliquots of SW480 cells per assay well in a 96-well round-bottom plate. Protease-treated and untreated anti-EpCAM×anti-CD3 composition samples were diluted in assay medium to the desired dose concentration and added in 20 microL to the respective experimental wells bringing the total assay volume to 200 microL. The protease-cleaved ProTIA was evaluated as a 12-point, 5× serial diluted dose concentration starting at 440 nM to obtain a final dose range of 0.000005 to 44 nM. The untreated non-cleaved ProTIA composition was analyzed as a 12 point, 5× serial diluted dose concentration starting at 184 nM to derive at a final dose range of 0.000002 to 18.4 nM. Assay controls that included spontaneous LDH released by effector and target cells; target cell maximum LDH released; volume correction control due to the addition of lysis solution and culture medium background were also set up at this time. For target spontaneous LDH released, SW480 cells were incubated in 200 microL of assay medium in the absence of any protease-treated or untreated composition. For effector spontaneous LDH released, PBMC were incubated in 200 microL of assay medium in the absence of any protease-treated or untreated composition. Target cell maximum LDH released was determined by the addition of 20 microL of 10× lysis solution to SW480 (220 microL total volume) and incubating the target cells in the presence of lysis solution for 45 min prior to harvesting the supernatant for LDH measurement. Volume correction control was achieved by adding 20 microL of 10× lysis solution to 200 microL of assay media, while culture medium background was obtained by incubating 200 microL of assay medium. The plate containing experimental wells of protease-treated and untreated anti-EpCAM×anti-CD3 ProTIA compositions and all the respective assay controls, all tested in duplicates, was then allowed to incubate overnight in a 37° C., 5% $CO_2$ humidified incubator.

The amount of LDH released into the supernatant as a result of cell lysis was measured using the Promega CytoTox Assay kit and following manufacturer's instructions. Briefly, 50 microL of the supernatant from each well of the assay plate was transferred to the corresponding well of a flat-bottomed enzymatic plate. To each well in the enzymatic plate, 50 microL of the reconstituted substrate was added. The plate was then covered, protected from light and allowed to incubate at room temperature for 30 min. After the desired incubation period, 50 microL of stop solution was added to each well and absorbance recorded at 490 nm.

Data analysis was then performed as followed:
1. Experimental, E:T ratio of 5:1 (average)–culture medium background (average) SW480 target spontaneous (average)–culture medium background (average) PBMC effector spontaneous (average)–culture medium background (average)
2. SW480 target maximum (average)–volume correction control (average)
3. % specific lysis=[(Experimental–SW480 target spontaneous–PBMC effector spontaneous)/(SW480 target maximum–SW480 target spontaneous)]×100
4. Dose concentration of protease-treated and untreated anti-EpCAM×anti-CD3 ProTIA was then plotted against % specific lysis; and the concentration of protein that gave half maximal response ($EC_{50}$) was derived with a 4-parameter logistic regression equation using GraphPad prism software.

Figure 25:
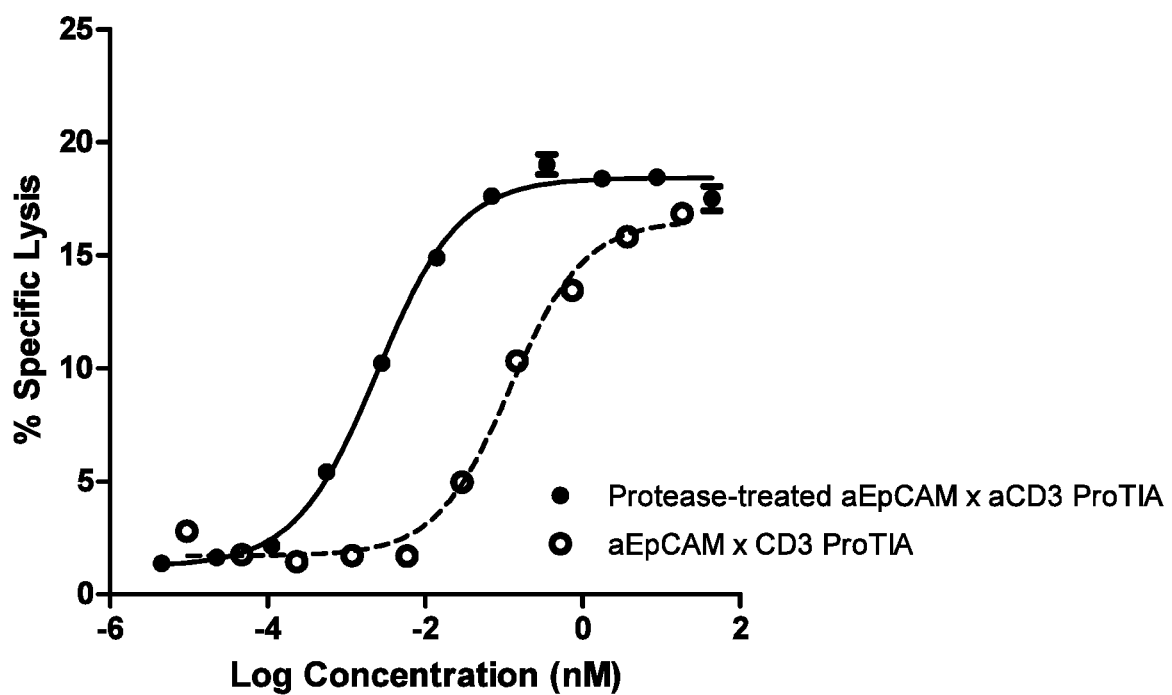
FIG. 25 depicts results from the experiment to determine the in vitro activity of protease-treated and untreated anti-EpCAM×anti-CD3 ProTIA, as described in Example 6.

As shown in FIG. 25, exposure of SW480 cells to protease-treated ProTIA and the untreated anti-EpCAM×anti-CD3 ProTIA compositions in the presence of PBMC yielded concentration-dependent cytotoxic dose curves; with the protease-treated ProTIA being 48-fold more active than the intact, untreated ProTIA ($EC_{50}$ of 2.5 pM vs. 120 pM respectively).

The specificity of the anti-EpCAM×anti-CD3 ProTIA was further evaluated by comparing the cytotoxic activity of protease-treated and protease-untreated ProTIA to that of unconjugated monospecific anti-EpCAM scFv and monospecific anti-CD3 scFv in the LDH assay. Briefly, PBMC and SW480 cells were co-cultured in an effector to target ratio of 5:1 in assay medium in a 96-well round-bottom plate as described above. Protease-treated anti-EpCAM×anti-CD3 ProTIA, protease-untreated anti-EpCAM×anti-CD3 ProTIA, and unconjugated monospecific anti-EpCAM scFv plus monospecific anti-CD3 scFv samples were all evaluated as a 12-point, 5× serial dilution of a final dose range of 0.00005 to 45 nM in a total assay volume to 200 microL. Together with experimental wells, all relevant assay controls as described above were also included in the assay plate and the plate was incubated overnight in a 37° C., 5% $CO_2$ humidified incubator.

The amount of LDH released into the supernatant as a result of cell lysis was measured using the Promega CytoTox Assay kit and results analyzed as described above.

Figure 26:
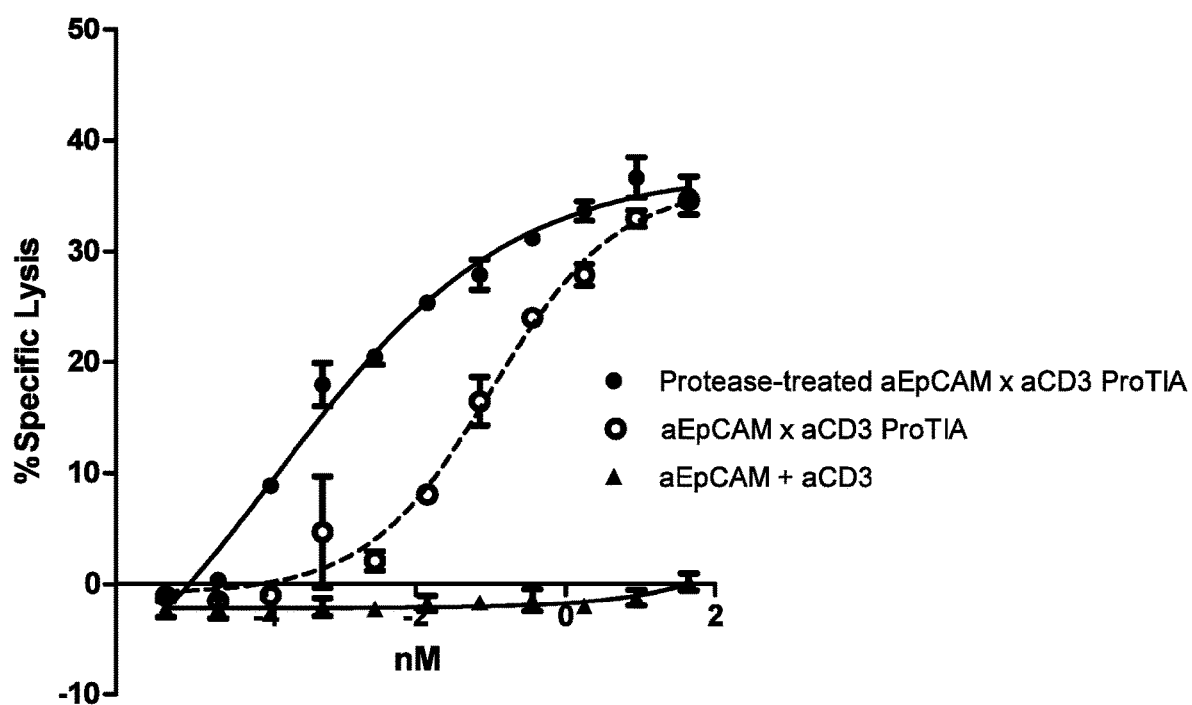
FIG. 26 depicts results from the experiment to determine the in vitro specificity of anti-EpCAM×anti-CD3 ProTIA, as described in Example 6.

As expected, exposure of SW480 cells to protease-treated anti-EpCAM×anti-CD3 ProTIA in the presence of PBMC show enhanced cytotoxicity as compared to untreated ProTIA. Significantly, combining monospecific anti-EpCAM scFv and monospecific anti-CD3 scFv in the presence of SW480 target cells and PBMC did not result in any cytotoxic activity (FIG. 26). The data indicate that linking the targeting aEpCAM moiety to the aCD3 effector moiety in the form of a bispecific molecule is required for the active recruitment of CD3 positive cells to the vicinity of the target cells for induced cytotoxicity.

We also hypothesized that the release segment cleavage sequence present in the anti-EpCAM×anti-CD3 ProTIA may by itself be susceptible to cleavage by proteases released by the tumor cells or by activated CD3 positive T cells (e.g. granzymes). To address this hypothesis, a non-cleavable anti-EpCAM×anti-CD3 ProTIA without the release segment (e.g. AC1357) was constructed and evaluated in conjugation with the protease-treated and untreated anti-EpCAM×anti-CD3 ProTIA (e.g. AC1278). All three ProTIA were analyzed in the LDH assay using a 5:1 PBMC to SW480 ratio and tested in a 12-point dose concentration range of 0.00005 to 45 nM achieved with a 5× serial dilution scheme.

Figure 27:
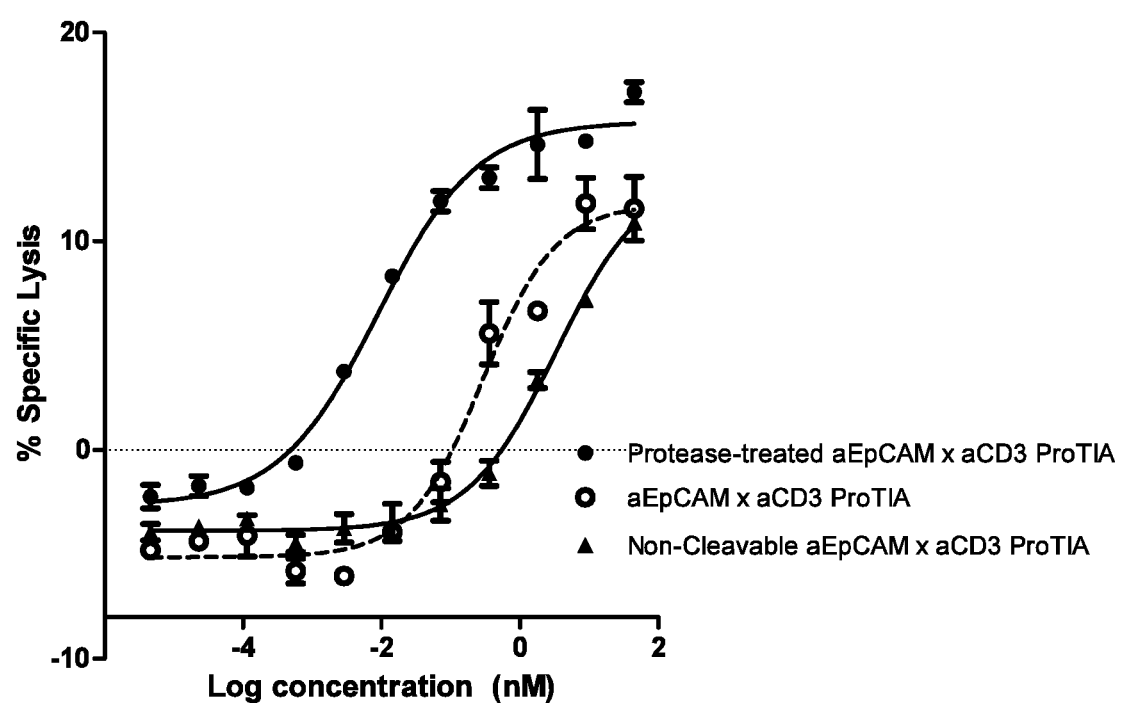
FIG. 27 depicts results from the experiment to determine the in vitro activity of protease-treated, protease-untreated and protease-uncleavable anti-EpCAM×anti-CD3 ProTIA, as described in Example 6.

As shown in FIG. 27, untreated anti-EpCAM×anti-CD3 ProTIA is 32-fold less active than protease-treated ProTIA ($EC_{50}$ of 288 pM vs. 8.9 pM). Interestingly, the non-cleavable anti-EpCAM×anti-CD3 ProTIA (i.e., ProTIA without the release segment cleavage sequence) is 371-fold less active than the protease-cleaved ProTIA ($EC_{50}$ of 3300 pM vs. 8.9 pM). The results suggest that the release segment contained within the cleavable anti-EpCAM×anti-CD3 ProTIA molecule is susceptible to some cleavage by proteases likely released from the tumor cells and/or activated CD3 positive T cells.

Figure 30:
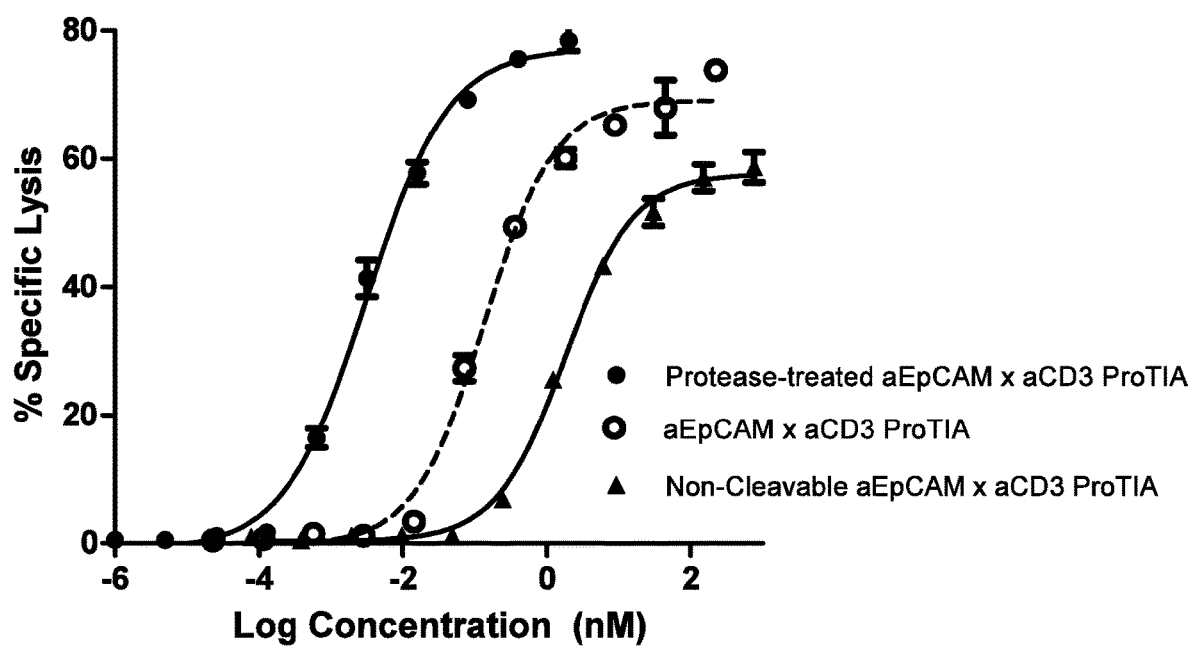
FIG. 30 depicts results from the experiment to determine the in vitro activity of protease-treated, protease-untreated and protease-noncleavable anti-EpCAM×anti-CD3 ProTIA in SK-OV-3 as described in Example 6.

The non-cleavable anti-EpCAM×anti-CD3 ProTIA without the release segment (e.g. AC1484) and protease-treated and untreated anti-EpCAM×anti-CD3 ProTIA (e.g. AC1476) were also evaluated in human cell line of ovarian origin. In this experiment, PBMC was mixed with SK-OV-3 ovarian cells in a ratio of 5:1 and all three ProTIA molecules were tested as a 12-point, 5× serial dilution dose curve in the LDH assay as described above. As expected, the activity trend of the three ProTIA molecules profiled in SK-OV-3 ovarian cell line was found to be similar to that observed in the SW480 colorectal cell line. In SK-OV-3 cells, untreated anti-EpCAM×anti-CD3 ProTIA was 45-fold less active than protease-treated ProTIA ($EC_{50}$ of 136 pM vs. 3 pM); and the non-cleavable anti-EpCAM×anti-CD3 ProTIA was 600-fold less active than the protease-cleaved ProTIA ($EC_{50}$ of 1793 pM vs. 3 pM) (FIG. 30).

Example 7: Cell Lysis Assessed by Flow Cytometry

For analysis of cell lysis after 24 h by flow cytometer, EpCAM positive SK-OV-3 target cells (or target cells selected from HCT-116, Kato III, MDA-MB-453, MCF-7, MKN45, MT3, NCI-N87, SK-Br-3, SW480, OVCAR3 and PC3 cell lines) are labeled with the fluorescent membrane dye CellVue Maroon dye (Affymetrix/eBioscience, cat #88-0870-16) according to manufacturer's instructions. Alternatively PKH26 (Sigma, cat #MINI26 and PKH26GL) can also be used. In brief, SK-OV-3 cells are washed twice with PBS followed by resuspension of $2\times10^6$ cells in 0.1 mL diluent C provided with the CellVue Maroon labeling kit. In a separate tube, 2 mircoL of CellVue Maroon dye is mixed with 0.5 mL diluent C, and then 0.1 mL added to the SK-OV-3 cell suspension. The cell suspension and CellVue Maroon dye are mixed and incubated for 2 min at room temperature. The labeling reaction is then quenched by the addition of 0.2 mL of FCS. Labeled cells are washed twice with complete cell culture medium (RPMI-1640 containing 10% FCS) and total number of viable cells determined by trypan blue exclusion. For an effector to target ratio of 5:1 in a total volume of 200 microL per well, $1\times10^5$ PBMC are co-cultured with $2\times10^4$ CellVue Maroon-labeled SK-OV-3 cells per well in a 96-well round-bottom plate in the absence or presence of the indicated dose range concentration of protease-treated and untreated anti-EpCAM×anti-CD3 ProTIA samples. After 24 h, cells are harvested with Accutase (Innovative Cell Technologies, cat #AT104) and washed with 2% FCS/PBS. Before cell acquisition on a Guava easyCyte flow cytometer (Millipore), cells are resuspended in 100 microL 2% FCS/PBS supplemented with 2.5 micrograms/mL 7-AAD (Affymetrix/eBioscience, cat #00-6993-50) to discriminate between alive (7-AAD-negative) and dead (7-AAD-positive) cells. FACS data are analyzed with guavaSoft software (Millipore); and percentage of dead target cells is calculated by the number of 7-AAD-positive/CellVue Maroon-positive cells divided by the total number of CellVue Maroon-positive cells.

Dose response kill curves of percent cytotoxicity against ProTIA concentration are analyzed by 4 parameter-logistic regression equation using GraphPad Prism; and the concentration of ProTIA that induced half maximal percent cell cytotoxicity is thus determined.

Cytotoxicity results utilizing flow cytometry are expected to be in line with results obtained with the LDH assay. Exposure of SK-OV-3 cells to protease-cleaved and uncleaved anti-EpCAM×anti-CD3 ProTIA compositions in the absence of PBMC are expected to have no effect. Similarly, PBMC are not expected to be activated in the presence of ProTIA without target cells. These results are expected to indicate that ProTIA compositions need to be clustered on the surface of target cells in order to stimulate PBMC for cytotoxicity activity. In the presence of PBMC and target cells, there would be a concentration-dependent cytotoxic effect due to ProTIA pretreated or untreated with protease. Further, results are expected to show that exposure of SK-OV-3 cells to untreated ProTIA (no protease) in the presence of PBMC would show reduced cytotoxicity as compared to protease-cleaved ProTIA composition.

The above set of cytotoxicity experiments is performed for other bispecific ProTIA compositions such as anti-CD19×anti-CD3 ProTIA composition and anti-HER2×anti-CD3 ProTIA composition. In these instances, CD19 and HER2 positive target cells will be used instead of EpCAM positive cells. Example cell lines for CD19 expressing cells will include but not limited to NAML-6, Blin-1, SKW6.4, Raji, Daudi and BJAB. For anti-HER2 targeting, HER2 positive cell lines such as SK-BR-3, BT474, HCC-1954, MDA-MB-453, SK-OV-3, NCI-N87, JIMT-1, HCT-116 will be used.

Example 8: T-Cell Activation Marker Assays of Anti-EpCAM×Anti-CD3 Protease Triggered Immune Activator (ProTIA) Composition To measure the anti-EpCAM×anti-CD3 ProTIA induced activation markers (CD69 and CD25), $1\times10^5$ PBMC or purified CD3+ cells were co-cultured in RPMI-1640 containing 10% FCS with 2×10⁴ SK-OV-3 or OVCAR3 cells per assay well (i.e., effector to target ratio of 5:1) in the presence of anti-EpCAM×anti-CD3 ProTIA in a 96-well round-bottom plate with total final volume of 200 microL. After 20 h incubation in a 37° C., 5% $CO_2$ humidified incubator, cells were stained with PECy5-conjugated anti-CD4, APC-conjugated anti-CD8, PE-conjugated anti-CD25, and FITC-conjugated anti-CD69 (all antibodies from BioLegend) in FACS buffer (1% BSA/PBS) at 4° C., washed twice with FACS buffer, and then resuspended in FACS buffer for acquisition on a Guava easyCyte flow cytometer (Millipore).

Figure 42A:
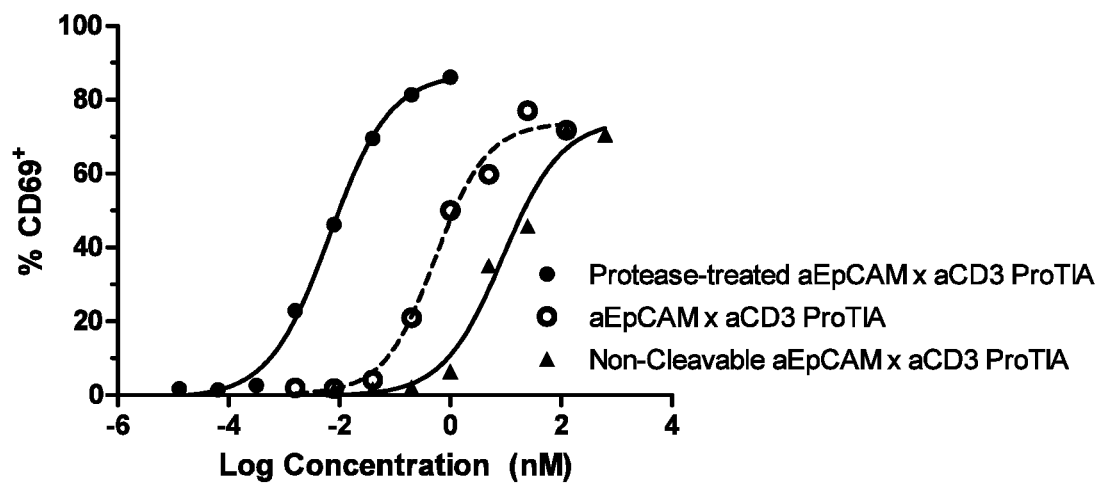
Figure 42B:
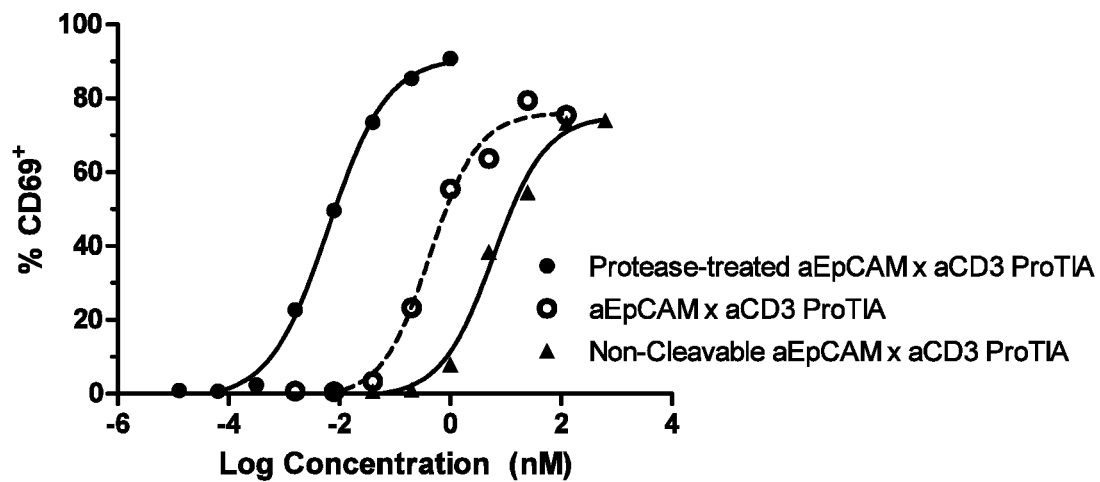
FIG. 42B depicts the activation of CD69 on CD4 cells.

As expected, the T-cell activation marker expression trend of the three ProTIA molecules profiled in SK-OV-3 ovarian cell line was found to be similar to that observed by LDH cytotoxicity assay. Using SK-OV-3 cells, activation of CD69 on CD8 and CD4 populations of PBMC by untreated anti-EpCAM×anti-CD3 ProTIA was ~70-fold less active than protease-treated ProTIA ($EC_{50}$ of 540 pM vs. 6.7 pM for CD8+, $EC_{50}$ of 430 pM vs. 6.3 pM for CD4+); and the non-cleavable anti-EpCAM×anti-CD3 ProTIA was ~1000-fold less active than the protease-cleaved ProTIA ($EC_{50}$ of 8700 pM vs. 6.7 pM for CD8+, $EC_{50}$ of 6000 pM vs. 6.3 pM for CD4+) (FIG. 42).

Figure 43A:
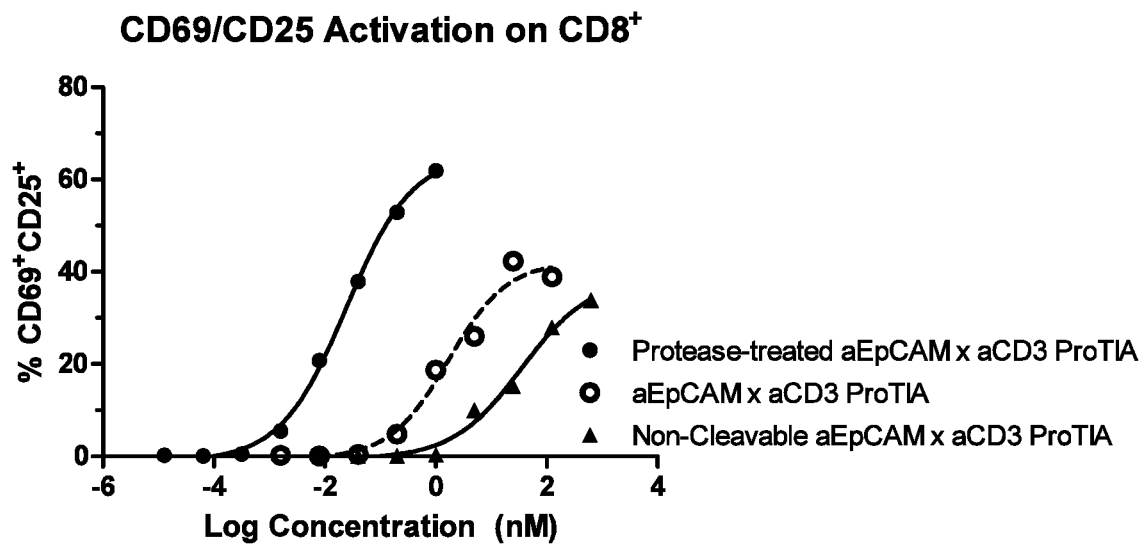
Figure 43B:
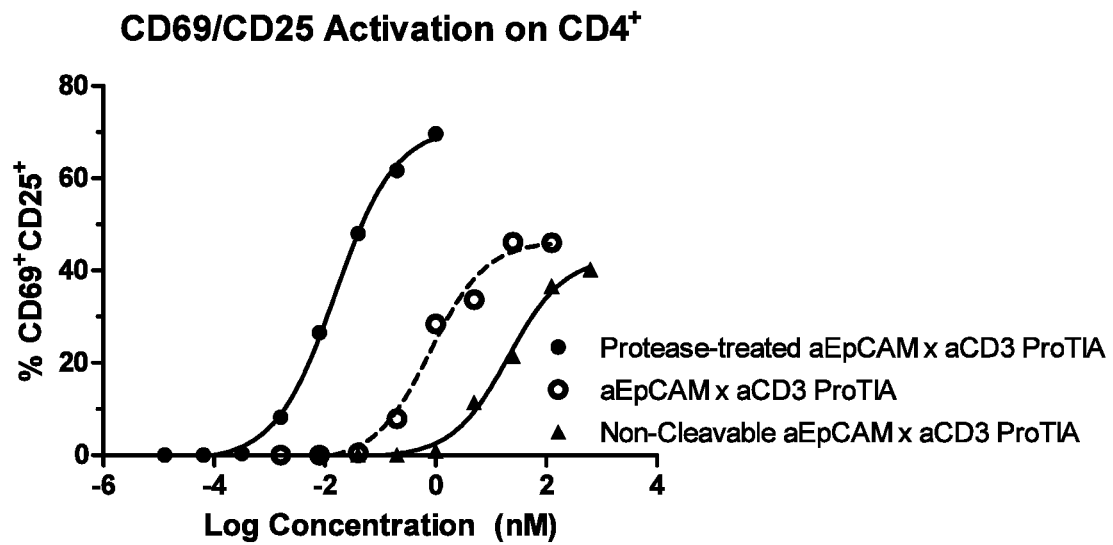
FIG. 43B depicts the activation of both CD69 and CD25 on CD4 cells.

Similarly, activation of both CD69 and CD25 on CD8 and CD4 populations of PBMC cells by untreated anti-EpCAM× anti-CD3 ProTIA was ~60-fold less active than protease-treated ProTIA, and the non-cleavable anti-EpCAM×anti-CD3 ProTIA was ~1300-fold less active than the protease-cleaved ProTIA (FIG. 43).

Figure 44A:
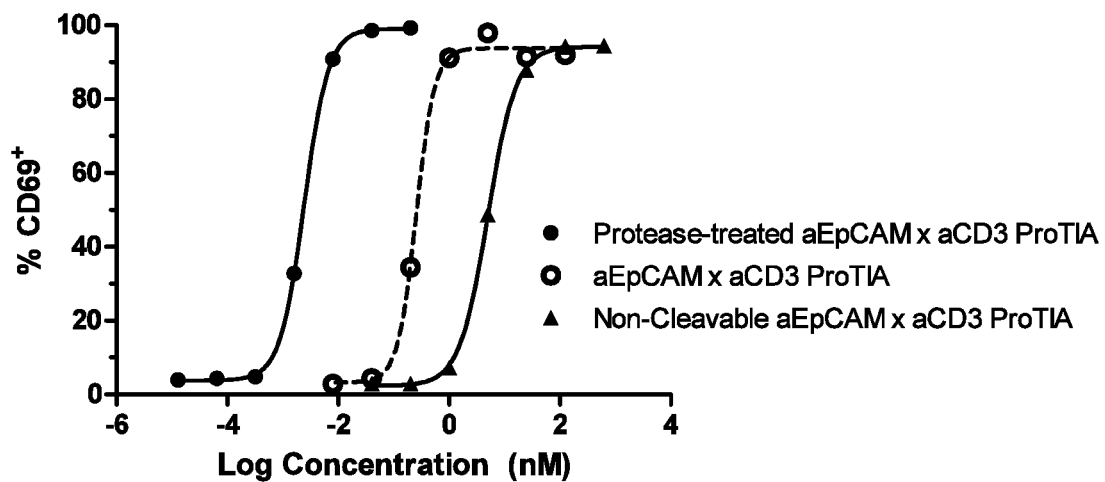
Figure 44B:
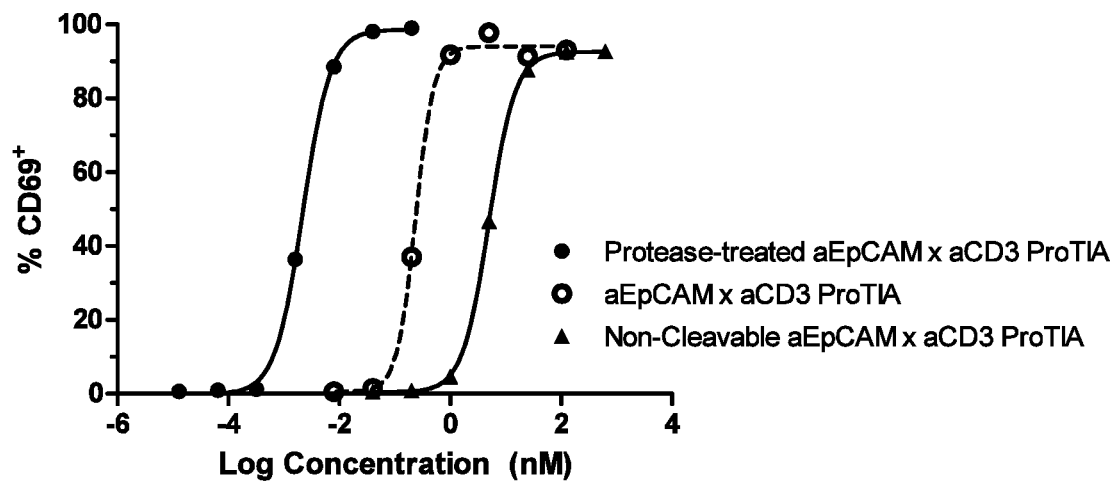
FIG. 44B depicts the activation of CD69 on CD4 cells.
Figure 45A:
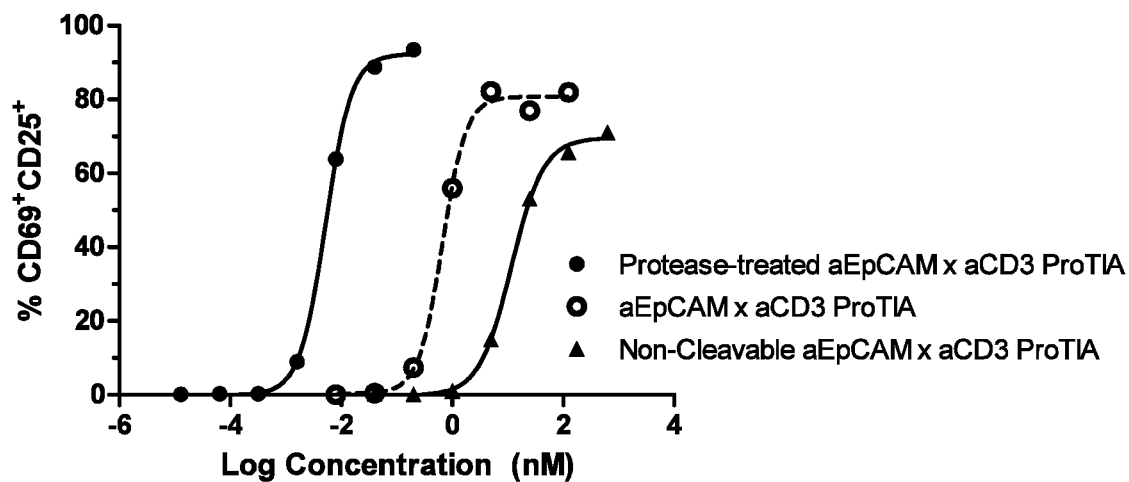
Figure 45B:
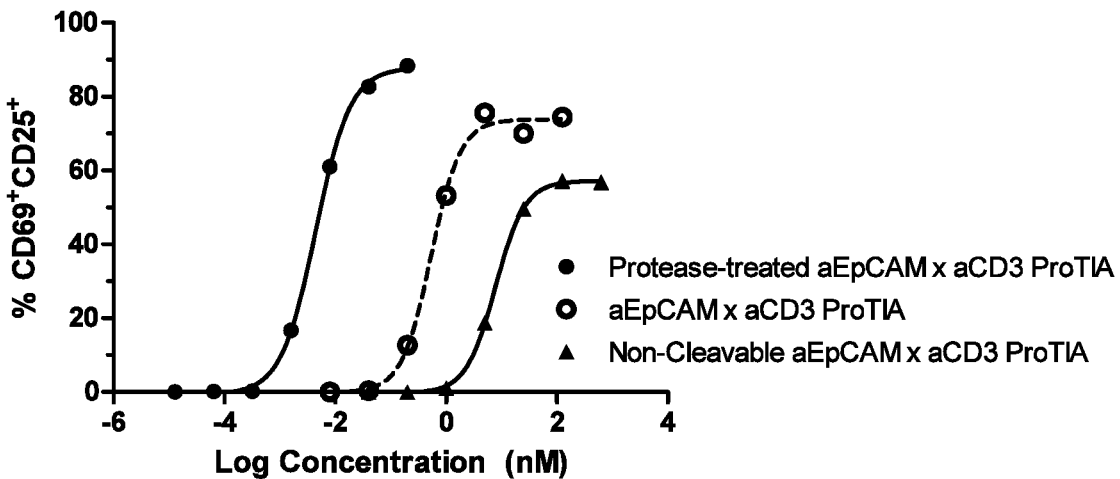
FIG. 45B depicts the activation of both CD69 and CD25 on CD4 cells.

To confirm the mechanism of action is through CD3+ cells, SK-OV-3 cells were used as target cells, and activation of CD69 on CD8 and CD4 populations of purified CD3+ cells by untreated anti-EpCAM×anti-CD3 ProTIA was ~100-fold less active than protease-treated ProTIA ($EC_{50}$ of 260 pM vs. 2.4 pM for CD8+, $EC_{50}$ of 240 pM vs. 2.2 pM for CD4+); and the non-cleavable anti-EpCAM×anti-CD3 ProTIA was ~2000-fold less active than the protease-cleaved ProTIA ($EC_{50}$ of 5000 pM vs. 2.4 pM for CD8+, $EC_{50}$ of 5000 pM vs. 2.2 pM for CD4+) (FIG. 44). Activation of both CD69 and CD25 on CD8 and CD4 populations of purified CD3+ cells by untreated anti-EpCAM×anti-CD3 ProTIA was ~100-fold less active than protease-treated ProTIA, and the non-cleavable anti-EpCAM×anti-CD3 ProTIA was ~2000-fold less active than the protease-cleaved ProTIA (FIG. 45).

Figure 46A:
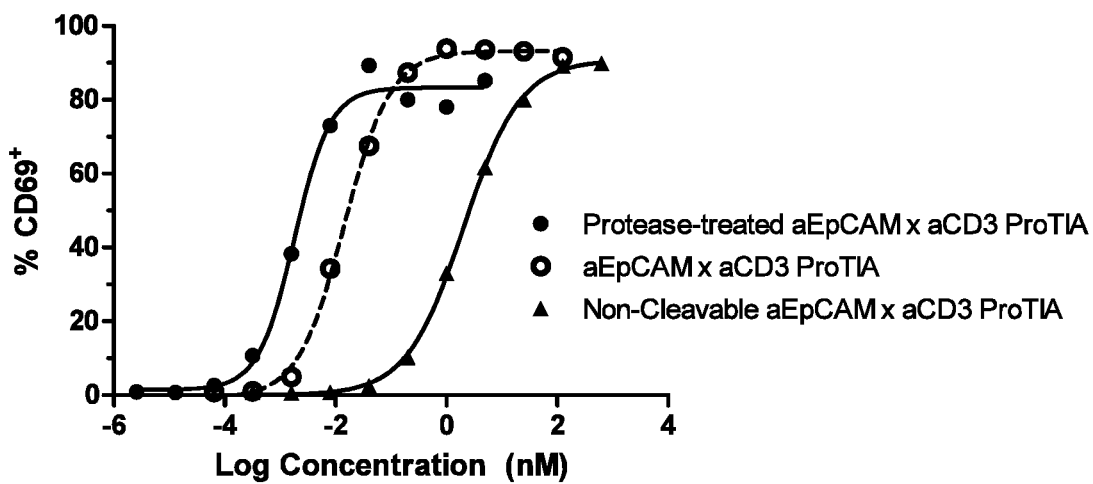
Figure 46B:
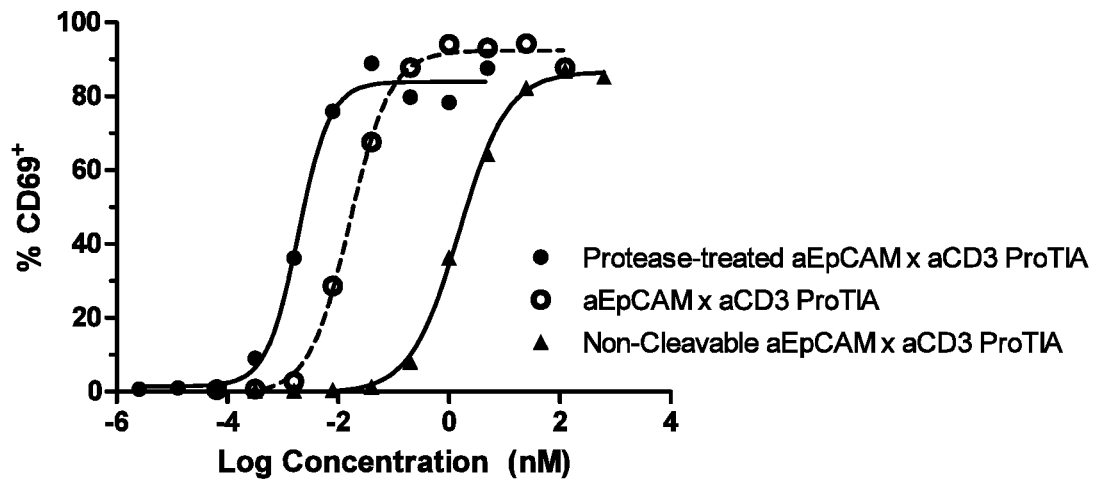
FIG. 46B depicts the activation of CD69 on CD4 cells.
Figure 47A:
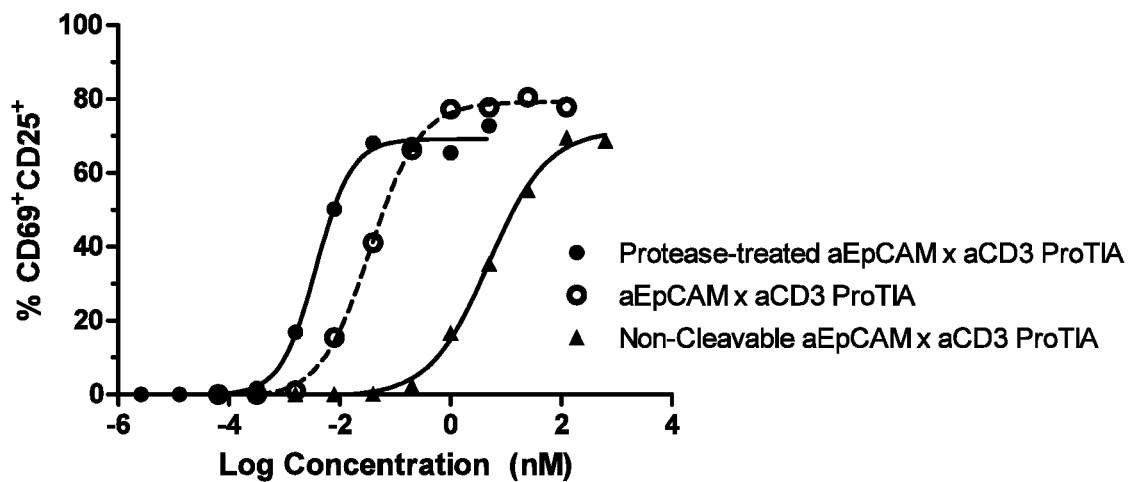
Figure 47B:
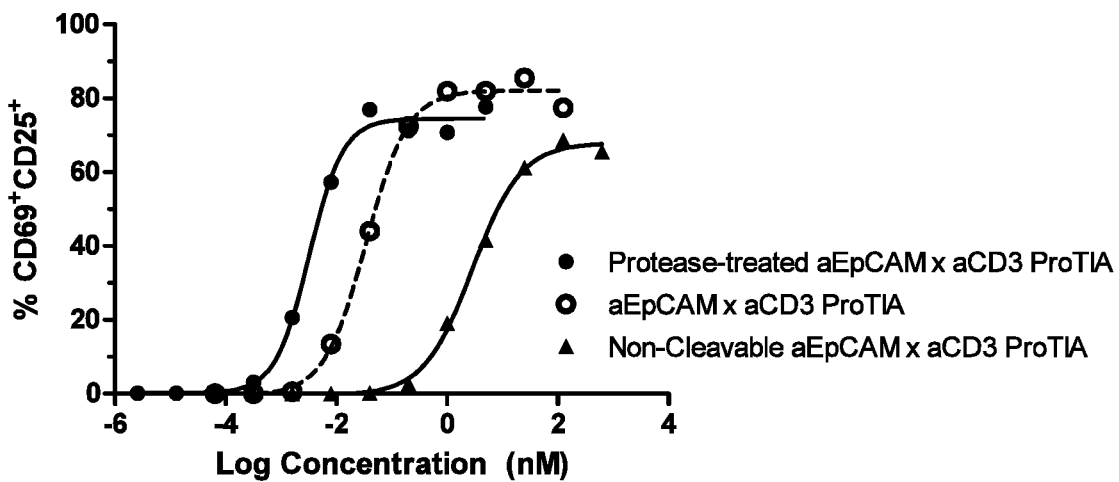
FIG. 47B depicts the activation of both CD69 and CD25 on CD4 cells.

Using OVCAR3 cells, activation of CD69 on CD8 and CD4 populations of purified CD3+ cells by untreated anti-EpCAM×anti-CD3 ProTIA was ~10-fold less active than protease-treated ProTIA ($EC_{50}$ of 14 pM vs. 1.8 pM for CD8+, $EC_{50}$ of 16 pM vs. 1.9 pM for CD4+); and the non-cleavable anti-EpCAM×anti-CD3 ProTIA was ~1000-fold less active than the protease-cleaved ProTIA ($EC_{50}$ of 2000 pM vs. 1.8 pM for CD8+, $EC_{50}$ of 1500 pM vs. 1.9 pM for CD4+) (FIG. 46). Activation of both CD69 and CD25 on CD8 and CD4 populations of purified CD3+ cells by untreated anti-EpCAM×anti-CD3 ProTIA was also ~10-fold less active than protease-treated ProTIA, and the non-cleavable anti-EpCAM×anti-CD3 ProTIA was also 1000-fold less active than the protease-cleaved ProTIA. These results suggest the untreated anti-EpCAM×anti-CD3 ProTIA was cleaved during the assay to a greater extent in the presence of OVCAR3 cells compared to SK-OV-3 cells (FIG. 47).

As further evidence of activation of T cells by anti-EpCAM×anti-CD3 ProTIA in the presence of target cells, induction of CD69 and granzyme B were measured. PBMC (1×10⁵) were co-cultured with 2×10⁴ OVCAR3 cells per assay well (i.e., effector to target ratio of 5:1) in the presence of anti-EpCAM×anti-CD3 ProTIA in a 96-well round-bottom plate with total final volume of 200 microL. After 20 h incubation in a 37° C., 5% $CO_2$ humidified incubator, cells were stained with PECy5-conjugated anti-CD4, APC-conjugated anti-CD8, and FITC-conjugated anti-CD69 (all antibodies from BioLegend) in FACS buffer (1% BSA/PBS) at 4° C. Cells were then fixed and permeabilized with 0.1% Triton X-100/PBS before staining with PE-conjugated anti-granzyme B (ThermoFisher, cat #MHGB04) in FACS buffer. Cells were washed with FACS buffer and then resuspended in FACS buffer for acquisition on a Guava easyCyte flow cytometer.

Figure 48A:
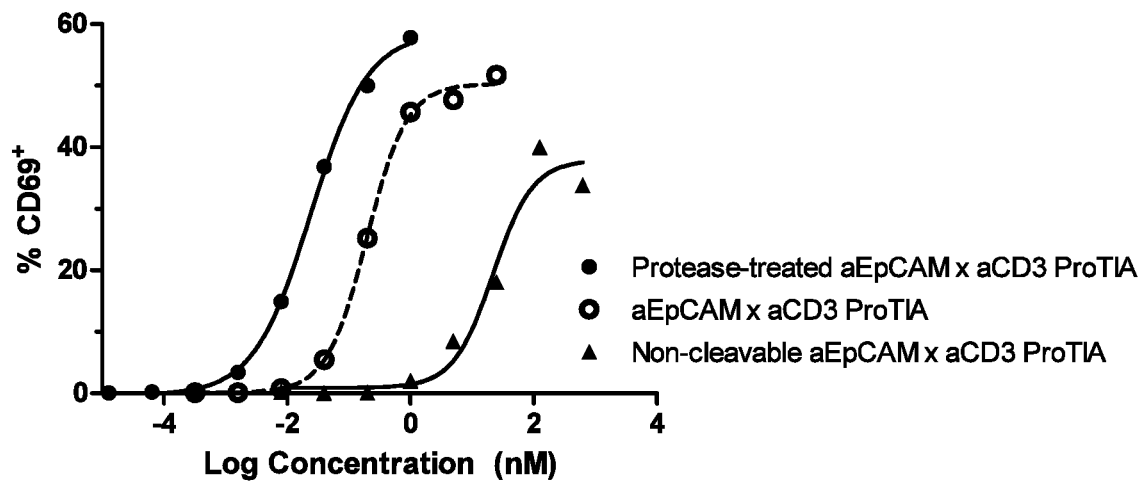
Figure 48B:
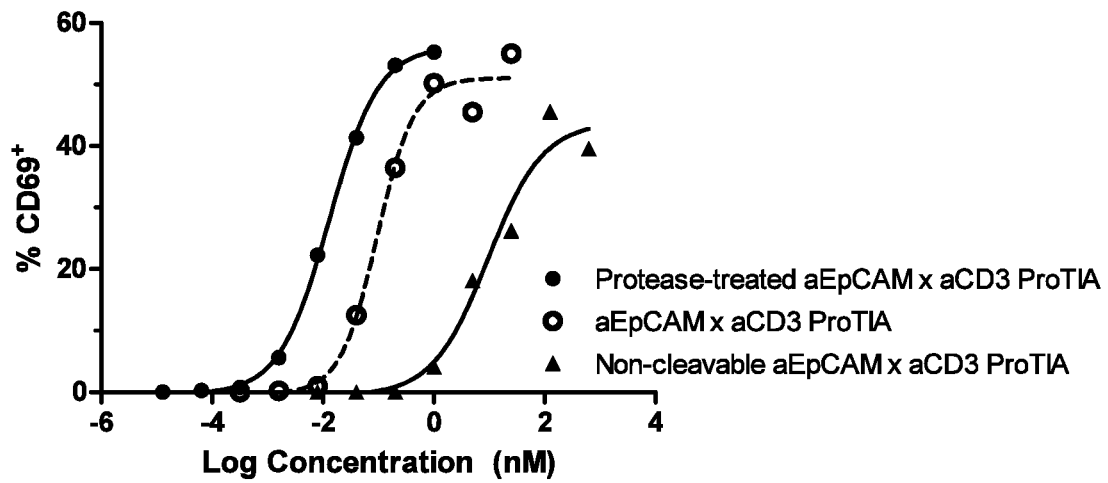
FIG. 48B depicts the activation of CD69 on CD4 cells.
Figure 49A:
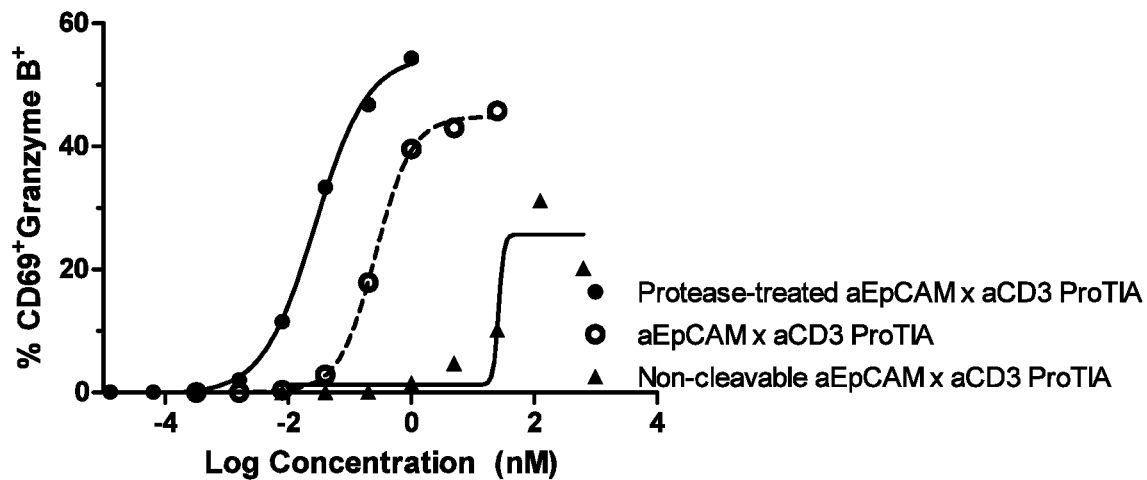
Figure 49B:
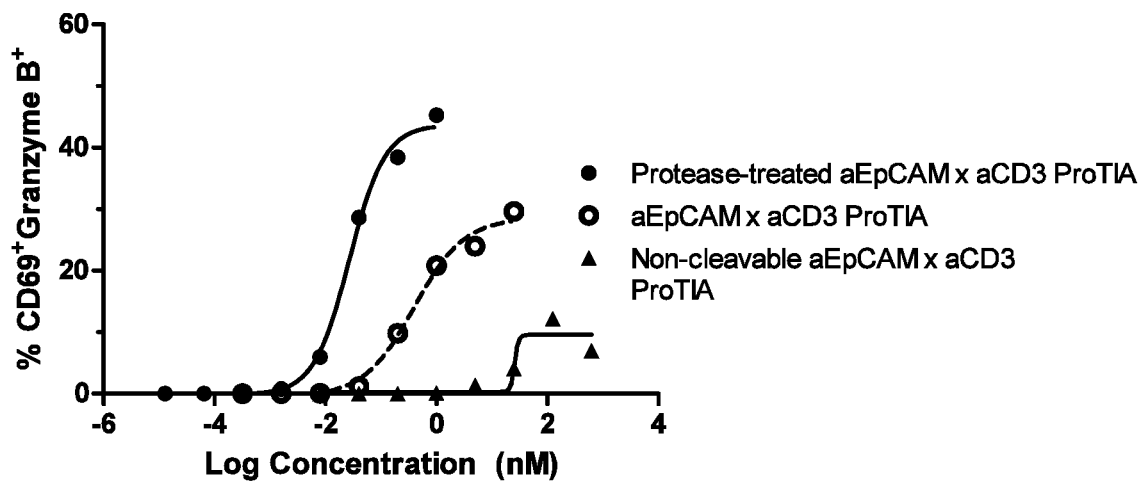
FIG. 49B depicts the activation of both CD69 and granzyme B in CD4 cells.

As expected, both CD69 and granzyme B are expressed in ProTIA-activated T cells in the presence of OVCAR3 cells. Additionally, a greater fraction of CD8+ cells express granzyme B compared to CD4+ cells (FIGS. 48 and 49).

Example 9: Pharmacokinetic Properties of Anti-EpCAM×Anti-CD3 Protease Triggered Immune Activator (ProTIA) Composition The pharmacokinetic properties of anti-EpCAM×anti-CD3 ProTIA were analyzed in C57BL/6 mice. Three mice in group 1 were injected intravenously with 4 mg/kg of protease-treated anti-EpCAM×anti-CD3 ProTIA (e.g. AC1278), and 3 mice in group 2 were injected intravenously with untreated anti-EpCAM×anti-CD3 ProTIA (e.g. AC1278). At appropriate time points, blood was collected into lithium heparinized tubes and processed into plasma. For the protease-treated anti-EpCAM×anti-CD3 ProTIA animals, plasma collection time points were pre-dose, 2 min, 15 min, 30 min, 2 h, 4 h, 8 h and 24 h. For the untreated ProTIA mice, plasma collection time points were pre-dose, 4 h, 8 h, 24 h, 2 d, 4 d, 6 d and 7 d. Plasma concentration of protease-treated ProTIA was quantified by a rhEpCAM/biotinylated-anti-His tag sandwich ELISA with the protease-cleaved ProTIA as standard; while plasma concentration of untreated ProTIA was quantified by a rhEpCAM/biotinylated-anti-XTEN sandwich ELISA with the uncleaved ProTIA as standard.

Briefly, ELISA plate (Nunc Maxisorp cat #442404) was coated with 0.1 mircog/100 microL per well of rhEpCAM (R&D Systems, cat #EHH104111). After overnight incubation at 4° C., the ELISA plate was washed and blocked with 3% BSA for 1 h at room temperature. The plate was washed again followed by the appropriate addition of a dose range of protease-treated and untreated anti-EpCAM×anti-CD3 ProTIA standards, appropriate quality controls and plasma test samples. The plate was allowed to incubate with shaking for 1 h at room temperature to allow the ProTIA standards, quality controls and test samples to bind to rhEpCAM coated on the plate. Unbound components were removed with several washes. For the detection of protease-cleaved ProTIA, biotinylated anti-His tag antibody (R&D Systems, cat #BAM050) was added at 0.2 microg/100 microL and plate allowed to incubate at room temperature for 1 h. For the detection of the protease-untreated ProTIA, biotinylated anti-XTEN antibody (Amunix proprietary antibody) was added at 0.1 microg/100 microL and the plate allowed to incubate at room temperature for 1 h. After washing away unbound biotinylated reagent, streptavidin-HRP (Thermo Scientific cat #21130) was added at 1:30,000 dilution and plate incubated at room temperature for 1 h. After several washes, TMB substrate was added to each well. Once desired color intensity was reached, 0.2 N sulfuric acid was added to stop the reaction and absorbance (OD) was measured at 450 nm using a spectrophotometer. The intensity of the color is proportional to the concentration of protease-treated and untreated ProTIA captured by the respective rhEpCAM/biotinylated-anti-His tag and rhEpCAM/biotinylated-anti-XTEN sandwich ELISA. The concentration of ProTIA present in the plasma samples was determined against the appropriate protease-treated or untreated ProTIA standard curve using SoftMax Pro software. Pharmacokinetic calculations of terminal half-life ($T_{1/2}$) of the protease-cleaved and uncleaved anti-EpCAM×anti-CD3 ProTIA were performed with GraphPad Prism.

Figure 28:
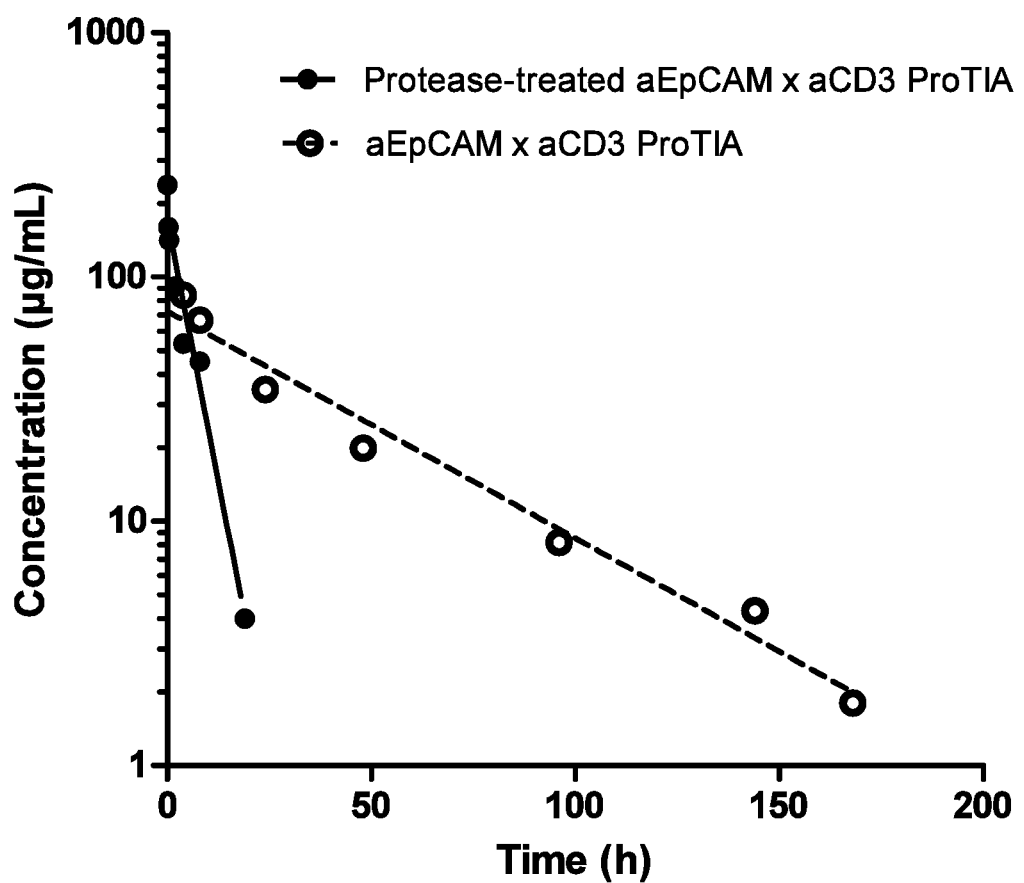
FIG. 28 depicts results from the experiment to determine the PK of protease-treated and untreated anti-EpCAM×anti-CD3 ProTIA, as described in Example 9.

In line with expectation, the protease-treated anti-EpCAM×anti-CD3 ProTIA has a short terminal elimination half-life ($T_{112}$) of about 3.5 h, whereas the protease-untreated ProTIA (with attached XTEN) has an extended $T_{112}$ of 32 h (FIG. 28), confirming that the intact ProTIA molecule has significantly longer half-life (at least 9-fold longer) than the cleaved molecule.

Example 10: Anti-Tumor Properties of Anti-EpCAM×Anti-CD3 Protease Triggered Immune Activator (ProTIA) Composition in Early Treatment SW40 Model An in vivo efficacy experiment—was performed in immunodeficient NOD/SCID mice, characterized by the deficiency of T and B cells, and impaired natural killer cells. Mice were maintained in sterile, standardized environmental conditions and experiment performed in accordance to US Institutional Animal Care Association for Assessment and Use Committee (IACUCAccreditation of Laboratory Animal Care (AAALAC) guidelines. The efficacy of protease-treated and protease-untreated anti-EpCAM×anti-CD3 ProTIA (e.g. AC1278) was evaluated using the human SW480 carcinoma xenograft model. Briefly, on day 0, six cohorts of 5 NOD/SCID mice per group were subcutaneously injected in the right flank with $1\times10^7$ human PBMC mixed with $1\times10^7$ SW480 cells. An hour after SW480/PBMC inoculation, cohort 1 was injected with vehicle (PBS+0.05% Tween 80), cohort 2 and 3 with 0.04 mg/kg and 0.4 mg/kg protease-treated anti-EpCAM×anti-CD3 ProTIA respectively, cohort 4 and 5 with 0.1 mg/kg and 1 mg/kg protease-untreated anti-EpCAM×anti-CD3 ProTIA and cohort 6 with 1 mg/kg protease-untreated anti-EpCAM×anti-CD3 ProTIA. Cohort 1 to 5, but not cohort 6, were further subjected to four additional doses administered daily from day 1 to day 4.

Tumors were measured twice per week for a projected 35 days with a caliper in two perpendicular dimensions and tumor volumes were calculated by applying the (width$^2$× length)/2 formula. Body weight, general appearance and clinical observations such as seizures, tremors, lethargy, hyper-reactivity, pilo-erection, labored/rapid breathing, coloration and ulceration of tumor and death were also closely monitored as a measure of treatment related toxicity. Study endpoint was defined as a tumor volume of 12002000 mm$^3$ or survival to 3536 days, whichever comes first. Percent tumor growth inhibition index (% TGI) was calculated for each of the treatment group by applying the formula: ((Mean tumor volume of PBSvehicle control−Mean tumor volume of ProTIA treatment)/mean tumor volume of PBSvehicle control)×100. Treatment group with % TGI≥60% is considered therapeutically active.

Figure 31:
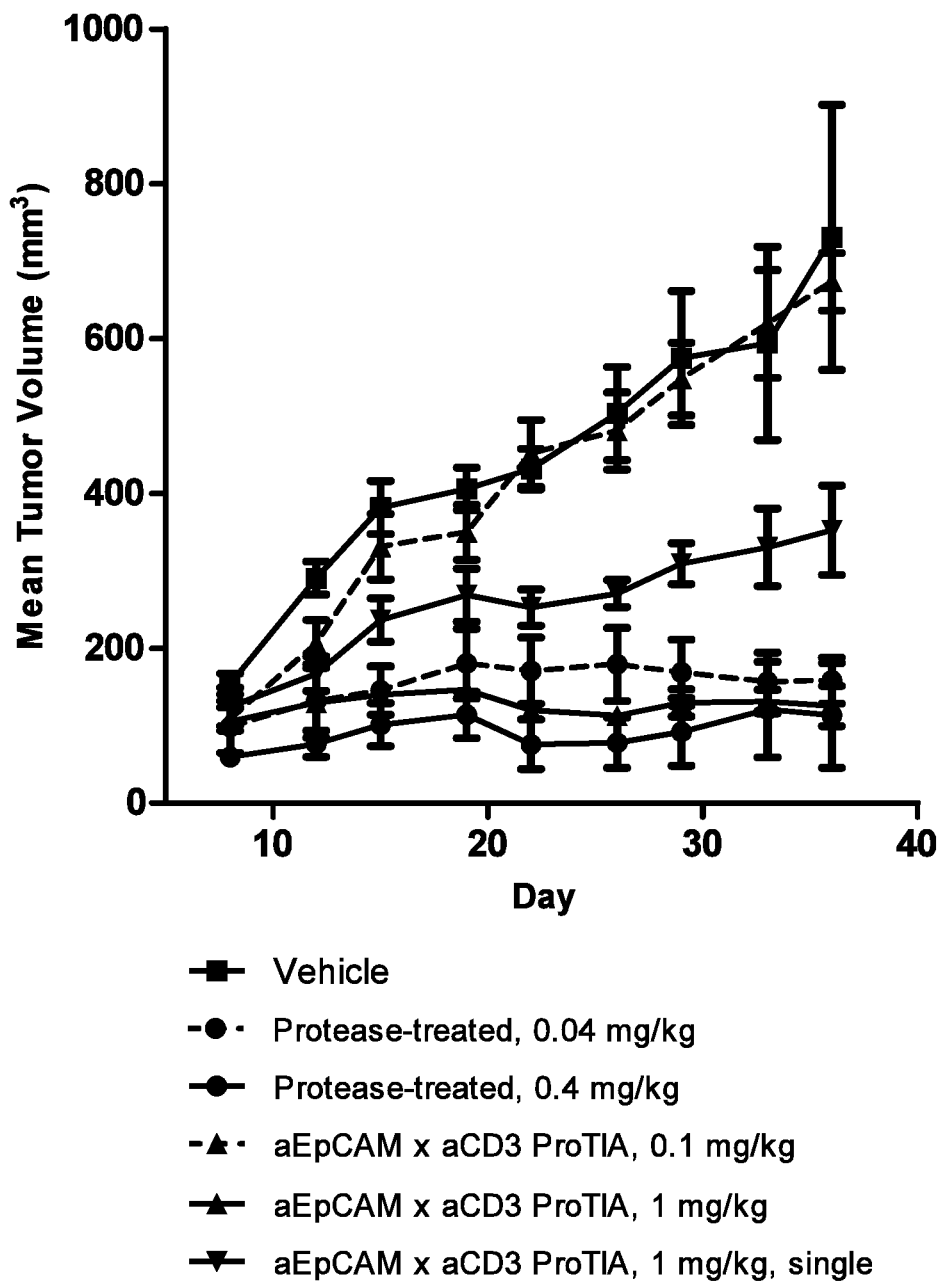
FIG. 31 depicts tumor volume results from experiment to determine the anti-tumor effect of protease-treated and untreated anti-EpCAM×anti-CD3 ProTIA, as described in Example 10.

At day 26, cohort 1 mice treated with PBSvehicle in the presence of human effector cells did not inhibit tumor progression, demonstrating that human effector cells alone as such could not elicit an anti-tumor effect. Treatment with the protease-treated anti-EpCAM×anti-CD3 ProTIA at 0.04 mg/kg and 0.4 mg/kg (cohort 2 and 3 respectively) in the presence of human effector cells exhibited clear dose-dependent response for suppression of tumor growth with the 0.4 mg/kg dose group providing more protection (% TGI=8584%) than the 0.04 mg/kg dose group (% TGI=6478%). Significantly, treatment with anti-EpCAM× anti-CD3 ProTIA at 1 mg/kg (cohort 5) in the presence of human effector cells also inhibited tumor growth (% TGI=7883%) to almost the same extend as molar-equivalent 0.4 mg/kg protease-treated ProTIA (cohort 3). Data suggest that at 1 mg/kg, sufficient anti-EpCAM×anti-CD3 ProTIA was effectively cleaved by proteases in the in vivo tumor environment to the more active, unXTENylated anti-EpCAM×anti-CD3 moiety to yield the observed efficacy. The lack of tumor regression in the 0.1 mg/kg protease-untreated anti-EpCAM×anti-CD3 ProTIA cohort 4 (% TGI=58%) suggested that at this dose, insufficient unXTENylated anti-EpCAM×anti-CD3 moiety was released to induced noticeable tumor regression. Cohort 6, subjected to a single 1 mg/kg dose of anti-EpCAM×anti-CD3 ProTIA, did not attained the threshold for therapeutic activity (% TGI=4652%) despite exhibiting suppressed tumor growth as compared to control group (FIG. 31). Results suggest that anti-EpCAM×anti-CD3 ProTIA can be effectively cleaved in the SW480 tumor environment to inhibit tumor progression and drug concentration plus exposure are important factors in determining drug efficacy.

Figure 32:
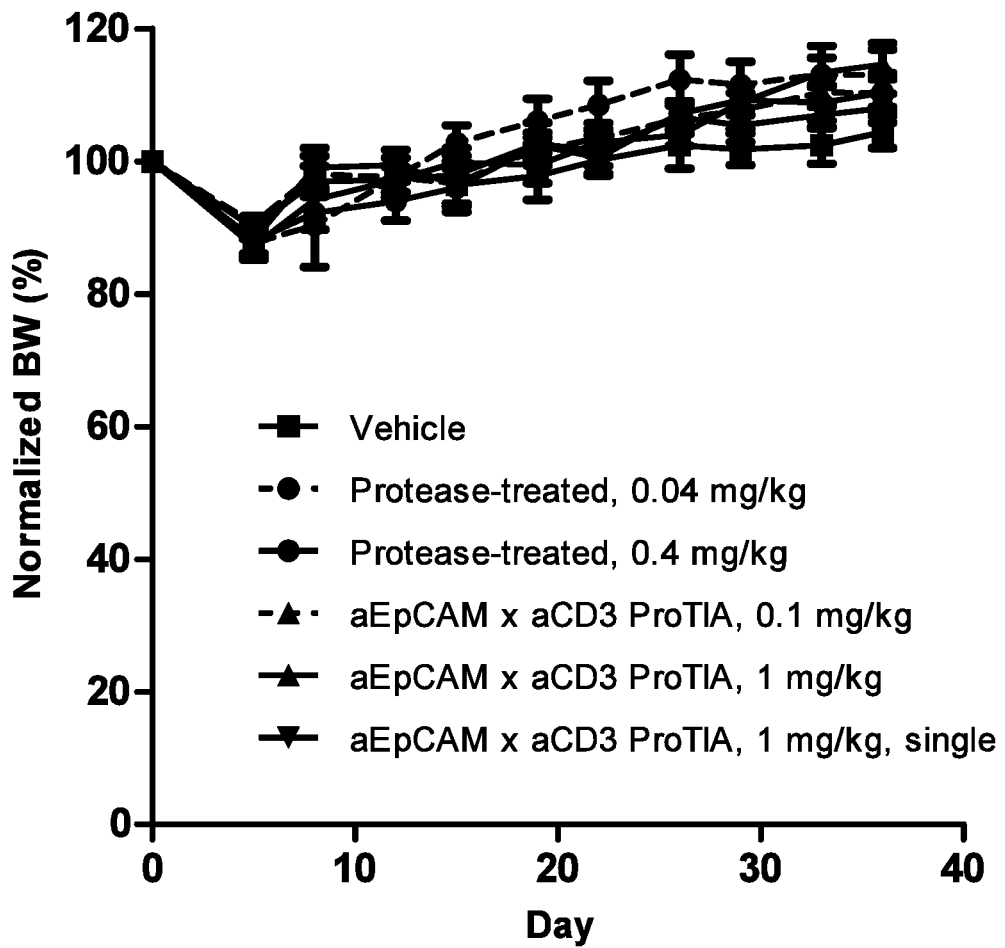
FIG. 32 depicts body weight results from an experiment to determine the anti-tumor effect of protease-treated and untreated anti-EpCAM×anti-CD3 ProTIA, as described in Example 10.

Of note, no significant body weight loss was observed in all ProTIA treatment groups and vehicle control indicating that all treatments were well tolerated (FIG. 32).

The specificity of the antitumor activity of anti-EpCAM× anti-CD3 ProTIA is performed in SW480/PBMC inoculated NOD/SCID mice much like the study described above but with eight mice per treatment group. In this study, early treatment with PBS vehicle control, non-cleavable anti-EpCAM×anti-CD3 ProTIA (e.g. AC1357 or AC1484), a bispecific negative control ProTIA (having the binding activity for CD3 but not for EpCAM), anti-EpCAM×anti-CD3 ProTIA or protease-treated anti-EpCAM×anti-CD3 ProTIA is initiated an hour after SW480/PBMC inoculation. The 1 mg/kg dose concentration of protease-untreated anti-EpCAM×anti-CD3 ProTIA as determined in the above study is used in this study and the bispecific negative control ProTIA, non-cleavable and protease-treated anti-EpCAM× anti-CD3 ProTIA test articles are all intravenously administered at equimolar concentration. Tumor volume, body weight and clinical observations are monitored two times per week for 35 days.

Treatment with PBS vehicle and the bispecific control ProTIA in the presence of human effector cells are not expected to induce anti-tumor effects, demonstrating that neither human effector cells alone nor a non-EpCAM targeting moiety could elicit an anti-tumor effect. Mice in both these treatment groups are expected to meet the study endpoint (day 35 or tumor volume of 2000 mm$^3$). Five daily doses of protease-treated and untreated anti-EpCAM×anti-CD3 ProTIA, in the presence of human effector are expected to induce suppression of tumor growth. Treatment with equimolar concentration of the non-cleavable ProTIA is expected to retard tumor growth but to a much lesser degree than that exhibited by the release segment bearing untreated ProTIA as it does not contain the substrate for protease cleavage.

Example 11: Anti-Tumor Properties of Anti-EpCAM×Anti-CD3 Protease Triggered Immune Activator (ProTIA) Composition in Established Colorectal Tumor Model In the established colorectal tumor model, SW480 and HCT-116 tumor cells are independently implanted into NOG (NOD/Shi-scid/IL-2Rγ$^{null}$) or NSG (NOD.Cg-Prkdc$^{scid}$.IL2rg$^{tm1wjl}$/SzJ) mice on day 0. (The NOG or NSG mice are NOD/SCID mice bearing IL-2Rγ mutation resulting in the mice lacking T, B and NK cells, dysfunctional macrophage, dysfunctional dendritic cells and reduced complement activity.) Human PBMC are then intravenously or intraperitoneally introduced sometime between days 3 to 10. When the SW480 and HCT-116 tumor have reached a volume of 150 mm³, treatment with protease-treated anti-EpCAM×anti-CD3 ProTIA, intact protease-untreated anti-EpCAM×anti-CD3 ProTIA and a non-cleavable form of anti-EpCAM×anti-CD3 ProTIA is initiated as five daily doses or as a single dose. It is expected that both protease-cleaved and protease-untreated ProTIA (e.g. AC1476) will lead to reduction or eradication of established SW480 and HCT-116 tumors, with the protease-untreated ProTIA imparting better therapeutic exposure over time resulting in a more efficacious anti-tumor effect and better safety profile than protease-treated ProTIA.

The non-cleavable anti-EpCAM×anti-CD3 ProTIA (e.g. AC1484) is expected to retard tumor growth, but to a much lesser degree than that exhibited by the release segment bearing protease-untreated ProTIA as it does not contain the substrate sequence for protease cleavage within the tumor environment.

Example 12: Cytometric Bead Array Analysis for Human Th1/Th2 Cytokines Using Stimulated Normal Healthy Human PBMCs and Intact and Protease-Treated Anti-EpCAM×Anti-CD3 ProTIA As a safety assessment of the ability of intact versus cleaved anti-EpCAM×anti-CD3 ProTIA to stimulate release of T-cell related cytokines in a cell-based in vitro assay, a panel of cytokines including IL-2, IL-4, IL-6, IL-10, TNF-alpha, IFN-gamma were analyzed using the cytometric bead array (CBA) on supernatants from cultured human PBMC stimulated with protease-treated and untreated anti-EpCAM×anti-CD3 ProTIA samples. The anti-human CD3 antibody, OKT3, was used as positive control and untreated wells served as negative control.

Briefly, OKT3 (0, 10 nM, 100 nM and 1000 nM) and protease-treated and untreated anti-EpCAM×anti-CD3 ProTIA (e.g. AC1278 at 10 nM, 100 nM, 1000 nM and 2000 nM) were dry coated onto a 96-well flat bottomed plate by allowing the wells to evaporate overnight in the biosafety hood. Wells were then washed once gently with PBS and 1×10⁶ PBMC in 200 microL were added to each well. The plate was then incubated at 37° C., 5% $CO_2$ for 24 h, after which tissue culture supernatant was collected from each well and analyzed for cytokine released using the validated commercial CBA kit (BD CBA human Th1/Th2 cytokine kit, cat #551809) by flow cytometry following manufacturer's instructions.

Figure 3A:
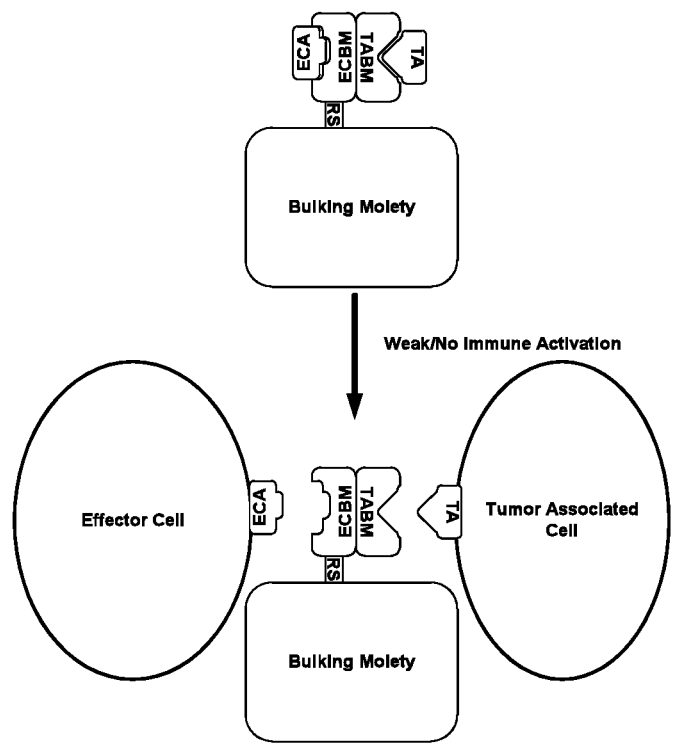
FIG. 3 shows the uncleaved "pro" form in FIG. 3A and the cleaved form in FIG. 3B in which the uncleaved form is depicted in proximity to an effector cell and a tumor associated cell, each with cell-surface antigens; however the uncleaved form in FIG. 3A is unable to concurrently bind the two cells because of the steric hindrance and shielding effects of the bulking moiety on the targeting (or binding) domains, while the cleaved form in FIG. 3B, with the released targeting domains, permits the concurrent binding of the two cells and allows and immune activation by the effector cell against the target tumor associated cell.
Figure 3B:
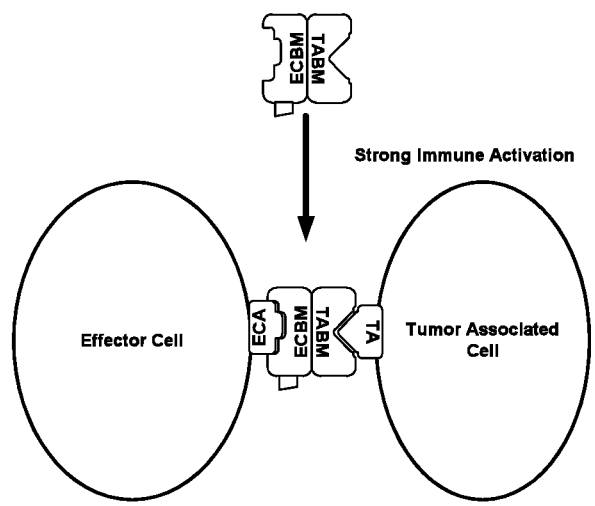
Figure 4:
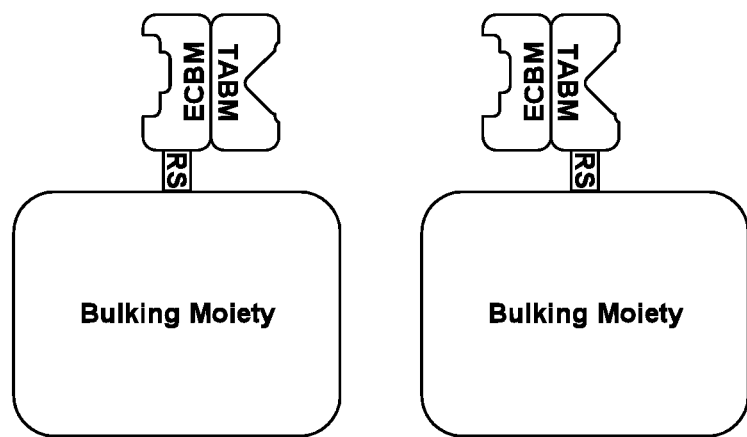
FIG. 4 shows schematic representations of two configurations of the ProTIA compositions, illustrating that the Release Segment and the bulking moiety can be attached to either the effector cell binding moiety or the tumor antigen binding moiety.
Figure 5A:
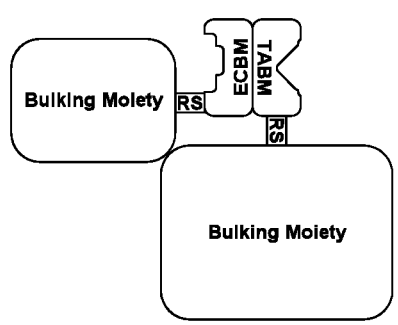
FIG. 5 shows schematic representations of two configurations of the ProTIA compositions in which two Release Segments and two bulking moieties are linked to the binding moieties. In the case of FIG. 5A, one RS and bulking moiety is linked to the effector cell binding moiety and the other RS and bulking moiety is linked to the tumor antigen binding moiety, and the composition would be in a scFv configuration. In the case of FIG. 5B, both RS and bulking moieties are attached to either the effector cell binding moiety (on the left) or the tumor antigen binding moiety (on the right), and the binding moieties would be in a diabody configuration (thus permitting the composition to be produced in recombinant form).
Figure 5B:
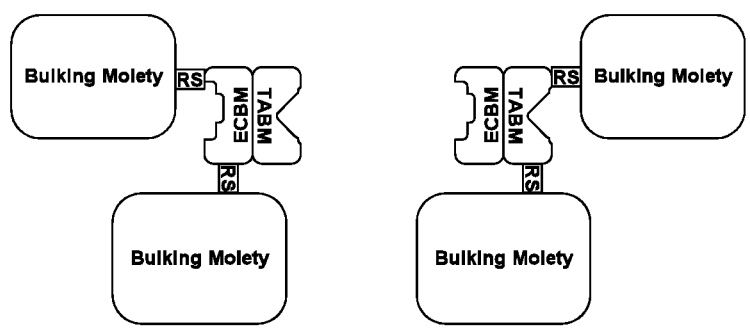
Figure 6A:
FIGS. 6A-6D shows schematic representations of two configurations of the ProTIA compositions in which the bulking moiety is an XTEN polypeptide, and the RS and bulking moiety is linked either to the effector cell binding moiety (on the left) or the RS and bulking moiety is linked to the tumor antigen binding moiety (on the right).
Figure 6B:
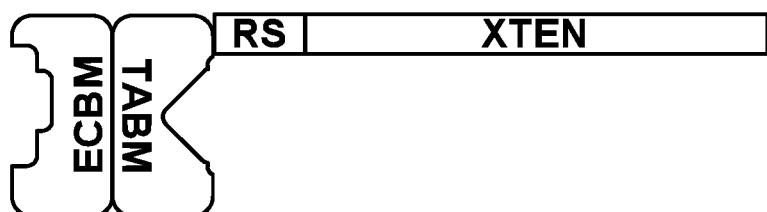
Figure 6C:
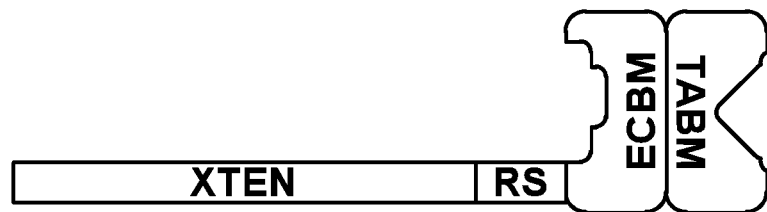
Figure 6D:
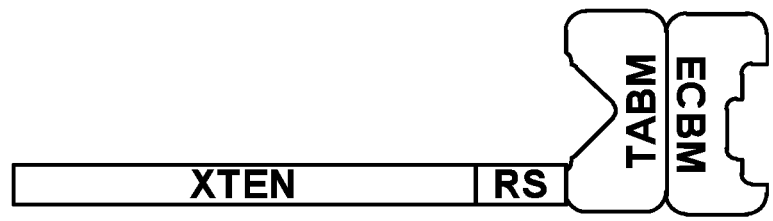
Figure 7A:
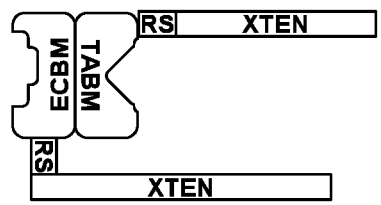
FIG. 7 shows schematic representations of two configurations of the ProTIA compositions in which two Release Segments and two XTEN are linked to the binding moieties. In the case of FIG. 7A, one RS and one XTEN is linked to the effector cell binding moiety and the other RS and bulking moiety is linked to the tumor antigen binding moiety, and the composition would be in a scFv configuration. In the case of FIG. 7B, both RS and XTEN are attached to either the effector cell binding moiety (on the right) or the tumor antigen binding moiety (on the left), and the binding moieties would be in a diabody configuration (thus permitting the composition to be produced in recombinant form).
Figure 7B:
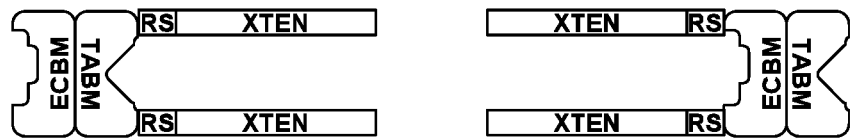
Figure 8A:
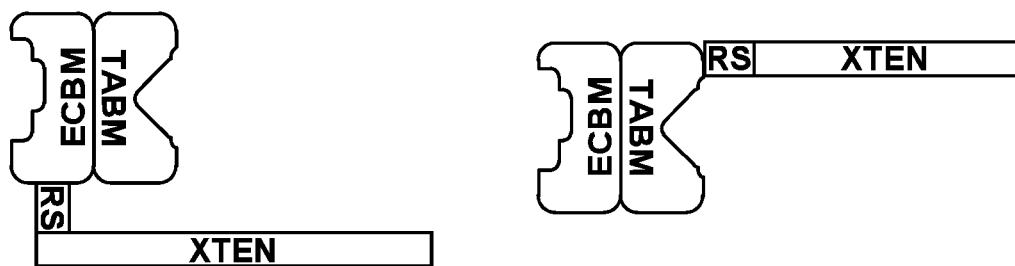
FIG. 8A depicts the binding moieties as XTEN.
Figure 8B:
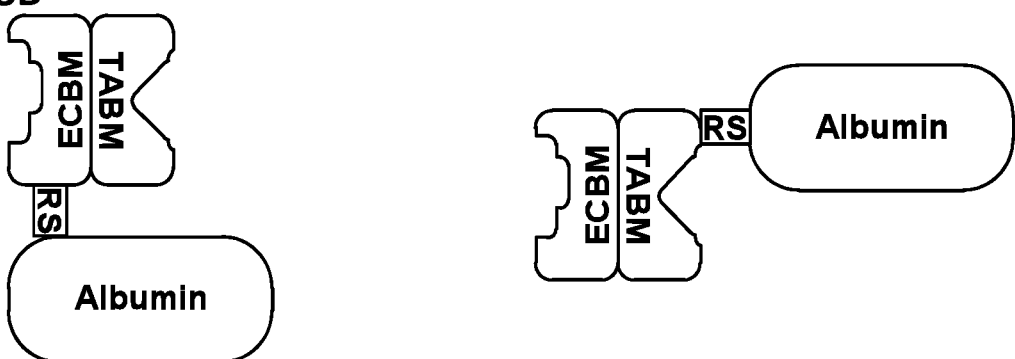
FIG. 8B depicts the binding moieties as albumin.
Figure 8C:
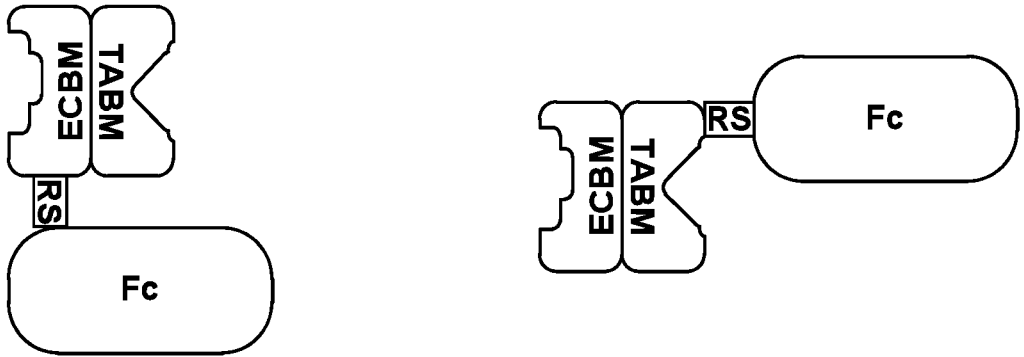
FIG. 8C depicts the binding moieties as an Fc fragment.
Figure 9A:
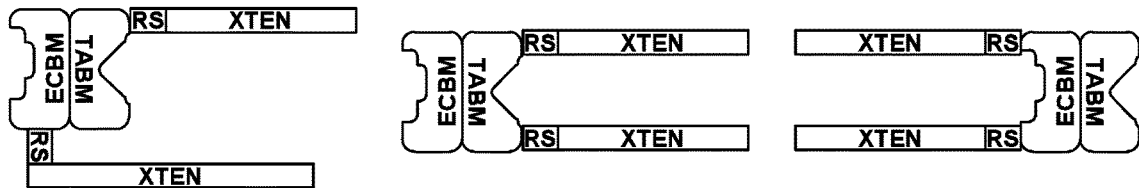
FIG. 9A depicts three configurations in which the two RS and XTEN are linked to both the effector cell binding moiety and the tumor antigen binding moiety (on the left), to the tumor antigen binding moiety (the center) or to the effector cell binding moiety (on the right).
Figure 9B:
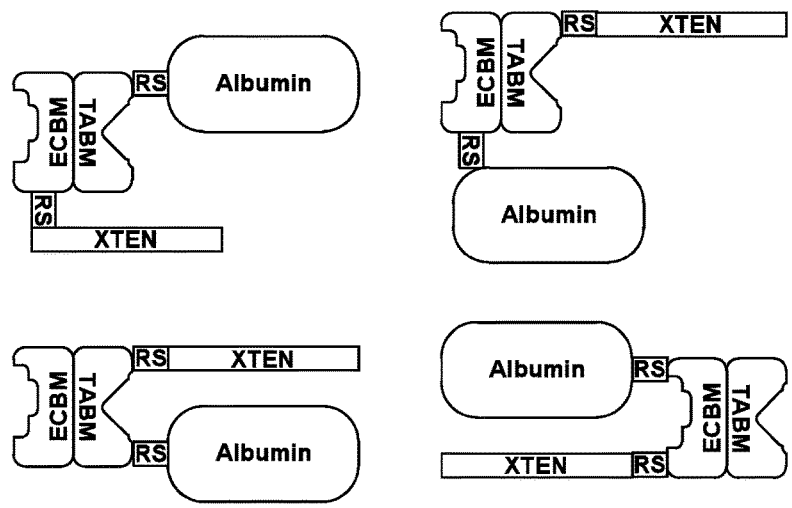
FIG. 9B depicts four configurations in which the one RS and XTEN are linked to the effector cell binding moiety and one RS and albumin are linked to the tumor antigen binding moiety (on the upper left), one RS and an XTEN are linked to the tumor antigen binding moiety and one RS and albumin are linked to the effector cell binding moiety (on the upper right), both the RS and an XTEN and the RS and albumin are linked to the tumor antigen binding moiety (on the lower left) and both the RS and an XTEN and the RS and albumin are linked to the effector cell binding moiety (on the lower right).
Figure 9C:
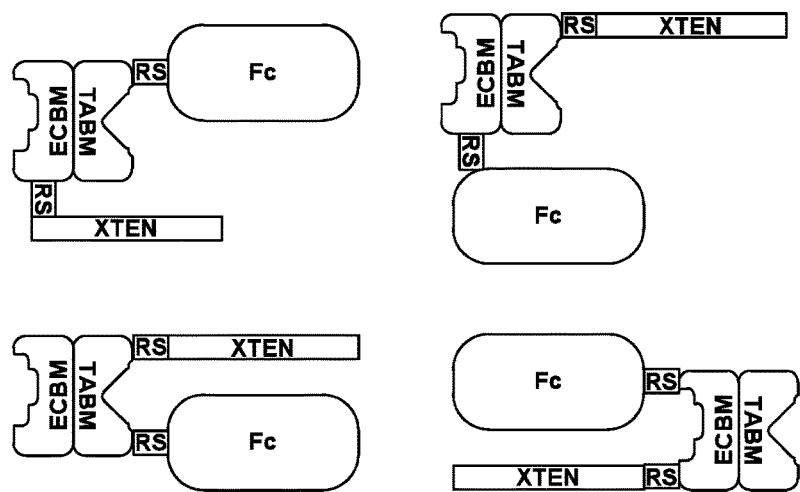
FIG. 9C depicts four configurations in which the one RS and XTEN are linked to the effector cell binding moiety and one RS and Fc are linked to the tumor antigen binding moiety (on the upper left), one RS and an XTEN are linked to the tumor antigen binding moiety and one RS and Fc are linked to the effector cell binding moiety (on the upper right), both the RS and an XTEN and the RS and Fc are linked to the tumor antigen binding moiety (on the lower left) and both the RS and an XTEN and the RS and Fc are linked to the effector cell binding moiety (on the lower right).
Figure 10:
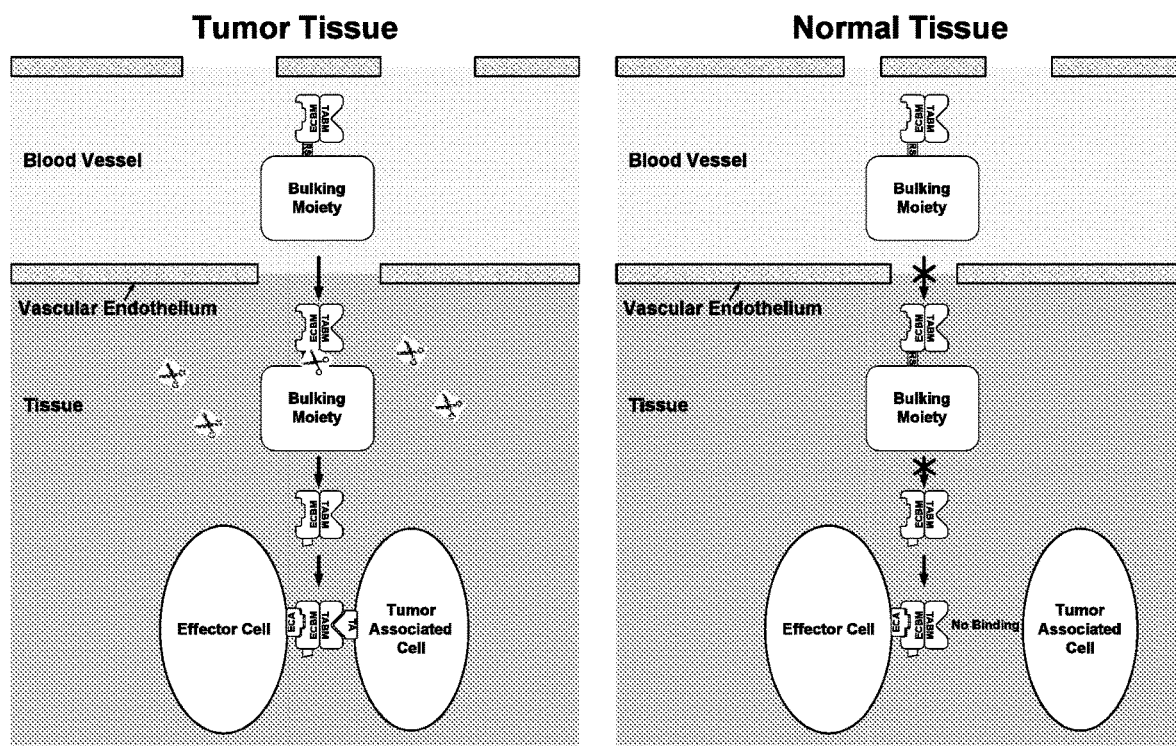
FIG. 10 shows schematic representations of a ProTIA in proximity to tumor tissue (on the left) and normal tissue (on the right) in which the more permeable vasculature in the tumor tissue permits the ProTIA to extravasate into the tissue where the tumor-associated proteases can act on the RS, cleaving it and releasing the binding moieties, which in turn can concurrently bind the effector cell and the tumor associated cell. In the case of the normal tissue, the extravasation is either blocked by the tighter vasculature barriers or, in the case where the ProTIA does extravasate, the ProTIA remains in the "pro" form and while able to bind the effector cell, no tumor cells are present or, if present, insufficient proteases are present to release the binding moieties, with the net effect that an immunological synapse is not formed.
Figure 11:
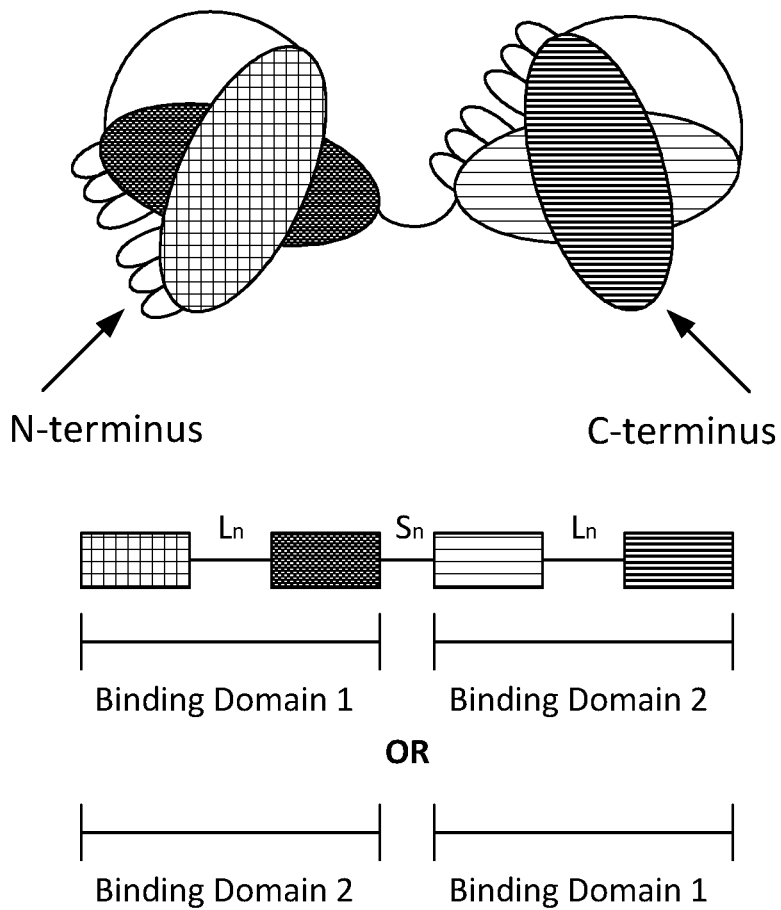
FIG. 11 shows a schematic representation of an scFv configuration of the effector cell binding moiety the tumor antigen binding moiety, each with VH/VL pairs joined by linkers, and in a tandem format.
Figure 12:
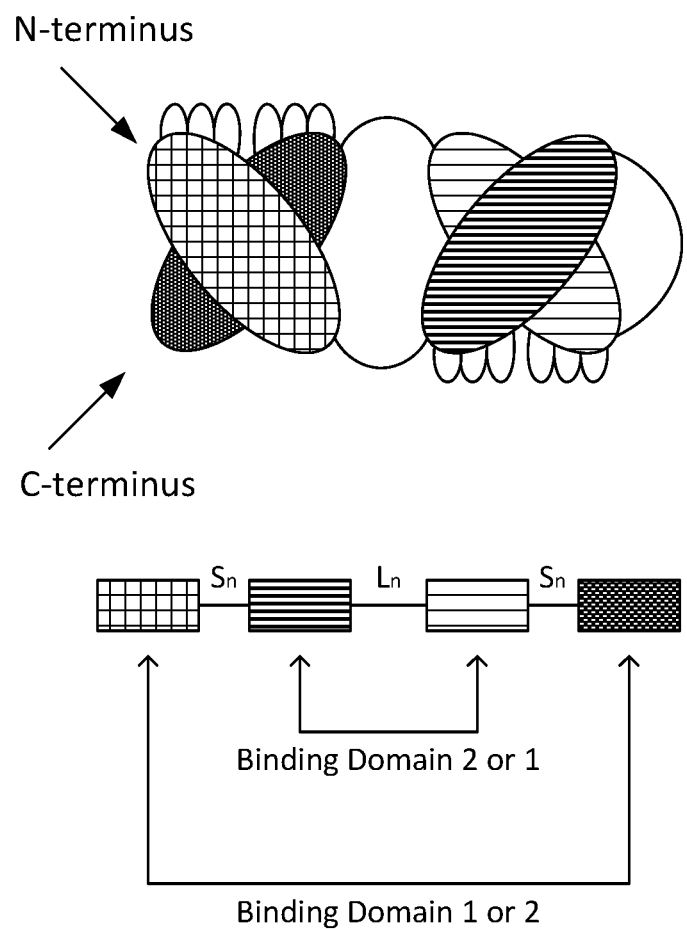
FIG. 12 shows a schematic representation of a diabody configuration of the effector cell binding moiety the tumor antigen binding moiety, each with VH/VL pairs joined by linkers.
Figure 13A:
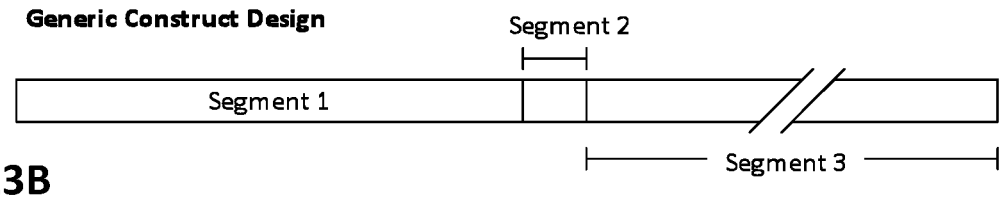
FIG. 13A shows a schematic representation of a generic construct design.
Figure 13B:
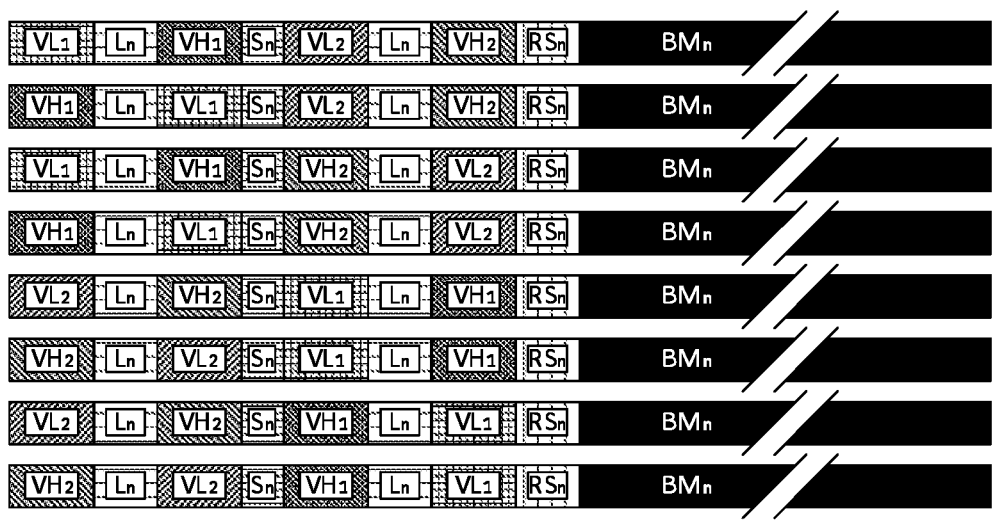
FIGS. 13B and 13C show schematic representations of ProTIA compositions in which the effector cell binding moiety and the tumor antigen binding moiety are in various permutations in scFv configurations (FIG. 13B) [with variable heavy (VH) and variable light (VL) domains linked either by intramolecular long linker (L) or intermolecular shorter linker (l)] and in diabody configurations (FIG. 13C) [with the VH and VL domains linked either by long linker (L) or intermolecular shorter linker (l).
Figure 13C:
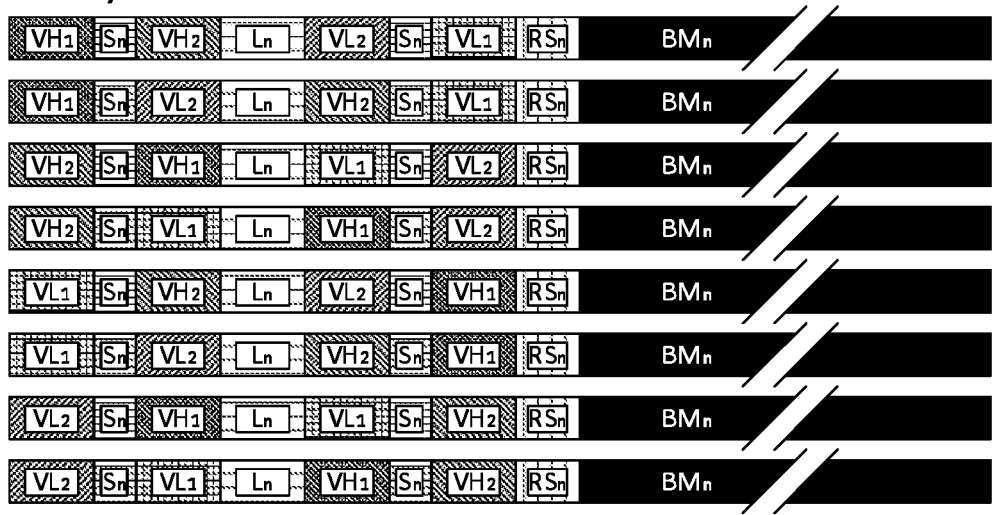
Figure 33A:
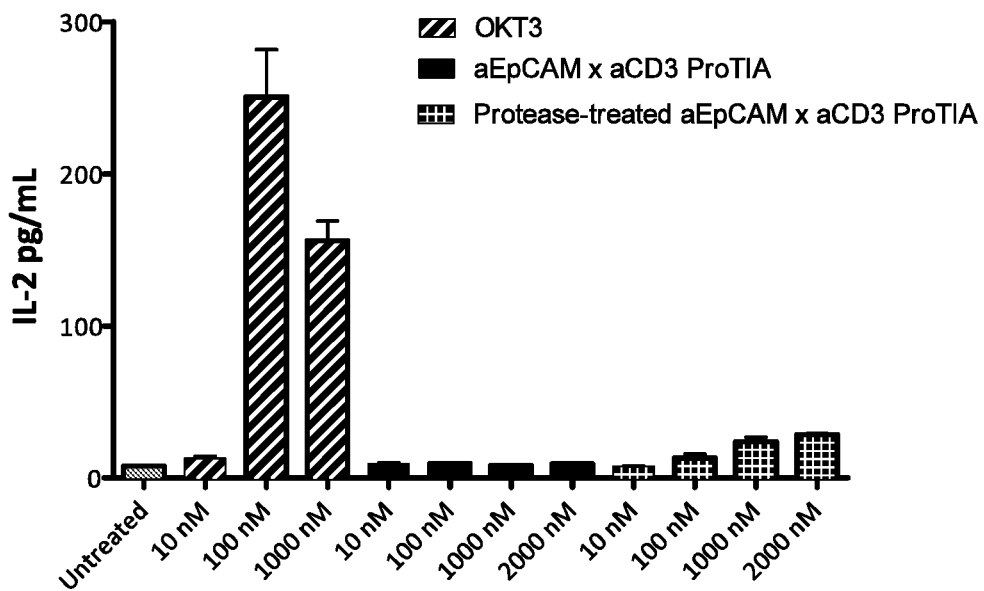
FIG. 33A shows the results of the assay to detect IL-2 and FIG. 33B shows the results to detect IL-4.
Figure 33B:
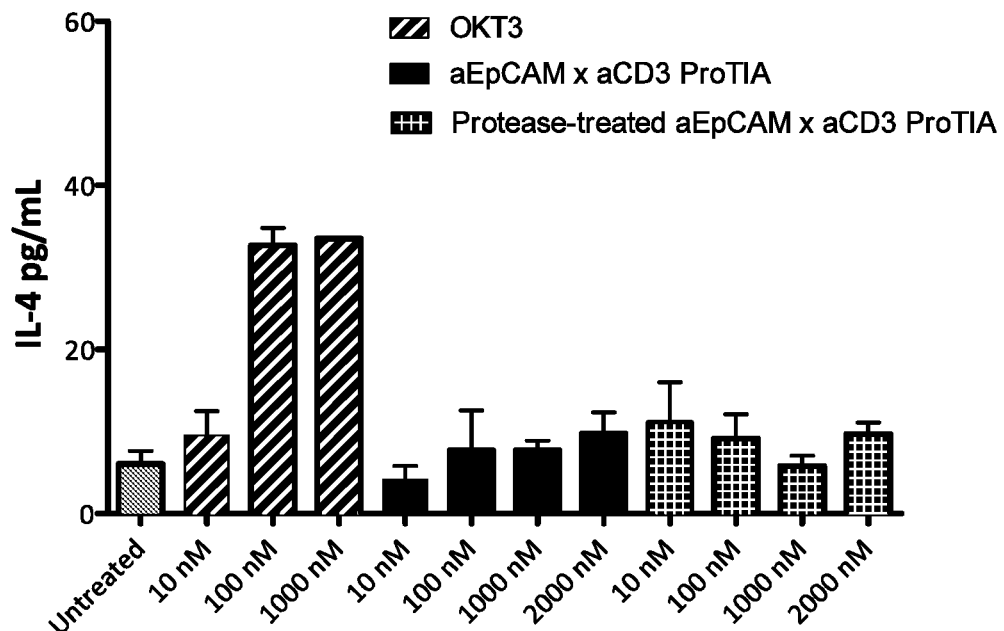

Results:

The raw data for detected levels of cytokines are presented in Table 11, and are depicted graphically in FIGS. 33-3.

TABLE 11

Cytokine levels in response to test compound

| Cytokine | Compound (nM) | Detected Cytokine (pg/ml) | | | |
|---|---|---|---|---|---|
| | | Untreated | OKT3 | ProTIA-X | ProTIA-A |
| IL-2 | 0 | 7.8 | | | |
| IL-4 | | 6.1 | | | |
| IL-6 | | 33.4 | | | |

TABLE 11-continued

Cytokine levels in response to test compound

| Cytokine | Compound (nM) | Detected Cytokine (pg/ml) | | | |
|---|---|---|---|---|---|
| | | Untreated | OKT3 | ProTIA-X | ProTIA-A |
| IL-10 | | 20.7 | | | |
| TNFa | | 2.1 | | | |
| IFNg | | 0.0 | | | |
| IL-2 | 10 | | 12.8 | 9.0 | 7.5 |
| IL-4 | | | 9.5 | 4.1 | 11.2 |
| IL-6 | | | 130.2 | 26.3 | 25.2 |
| IL-10 | | | 23.8 | 20.8 | 16.8 |
| TNFa | | | 6.1 | 4.8 | 2.1 |
| IFNg | | | 47.4 | 1.5 | 1.1 |
| IL-2 | 100 | | 250.6 | 9.4 | 13.1 |
| IL-4 | | | 32.7 | 7.7 | 9.2 |
| IL-6 | | | 6658.1 | 22.9 | 56.4 |
| IL-10 | | | 486.3 | 18.3 | 20.7 |
| TNFa | | | 6120.1 | 2.8 | 10.0 |
| IFNg | | | 15512.9 | 3.5 | 106.5 |
| IL-2 | 1000 | | 156.0 | 8.1 | 23.8 |
| IL-4 | | | 33.5 | 7.7 | 5.8 |
| IL-6 | | | 7962.1 | 32.7 | 3683.7 |
| IL-10 | | | 206.0 | 16.4 | 88.0 |
| TNFa | | | 10118.1 | 4.6 | 91.5 |
| IFNg | | | 14060.9 | 0.0 | 1371.5 |
| IL-2 | 2000 | | | 9.2 | 28.5 |
| IL-4 | | | | 9.8 | 9.7 |
| IL-6 | | | | 35.2 | 589.3 |
| IL-10 | | | | 16.9 | 163.9 |
| TNFa | | | | 3.1 | 250.4 |
| IFNg | | | | 0.4 | 3330.0 |

Figure 34A:
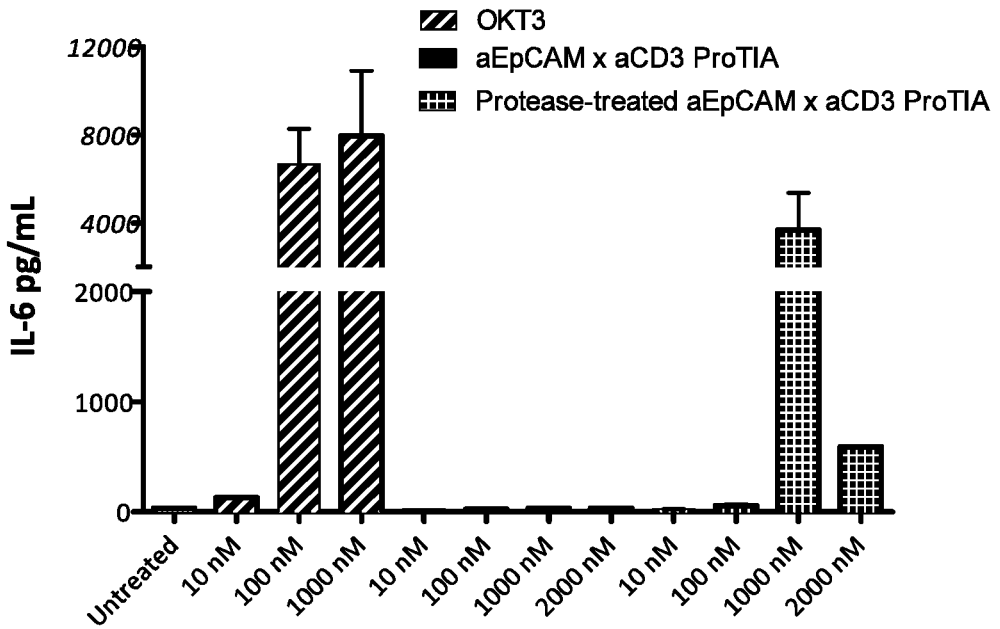
FIG. 34A shows the results of the assay to detect IL-6 and FIG. 34B shows the results to detect IL-10.
Figure 34B:
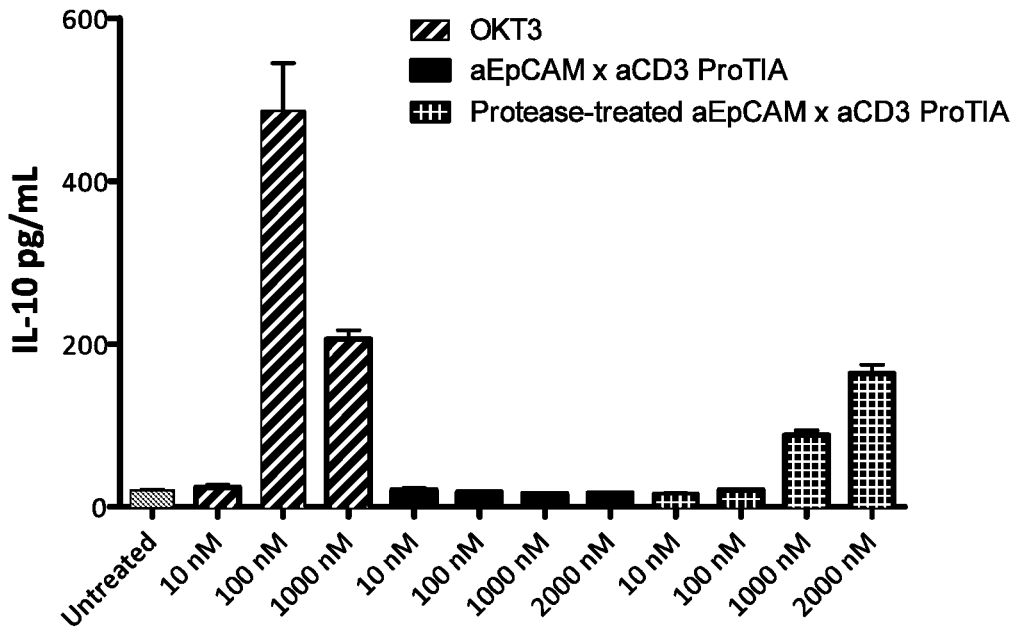
Figure 35A:
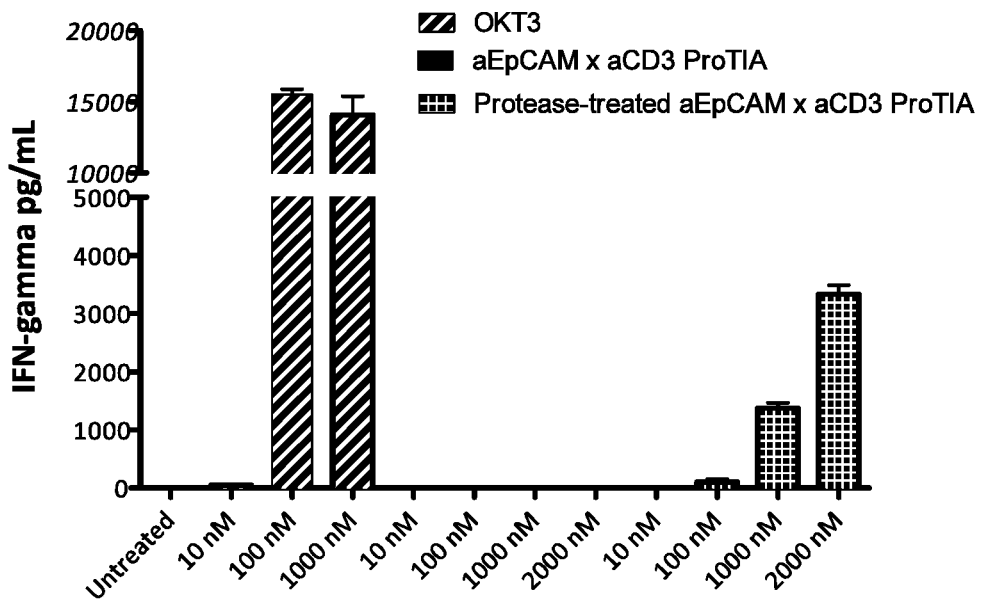
FIG. 35A shows the results of the assay to detect IFN-gamma and FIG. 35B shows the results to detect TNF-alpha.
Figure 35B:
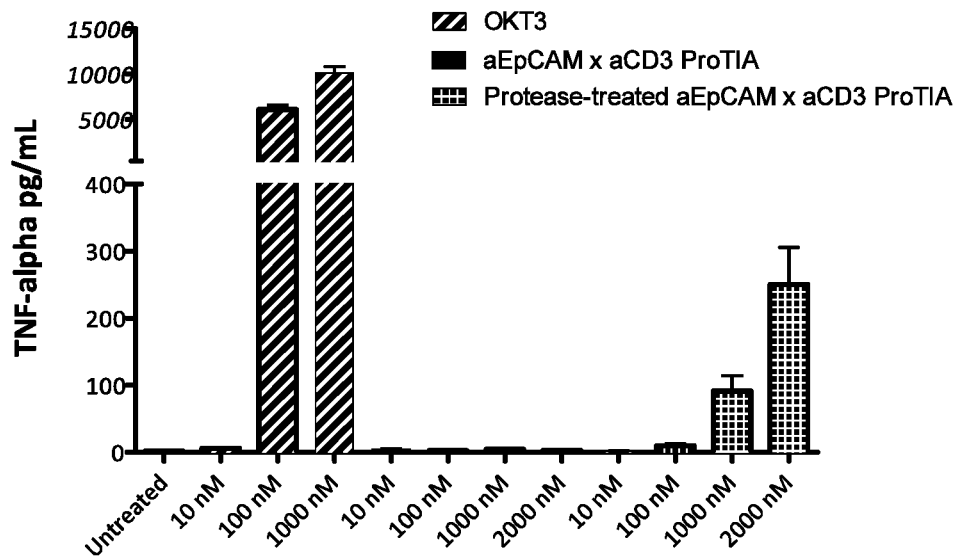

As expected, OKT3, but not untreated wells, induced robust secretion of all cytokines (IL-2, IL-4, IL-6, IL-10, TNF-alpha, IFN-gamma) evaluated, thereby confirming the performance of the CBA cytokine assay. Stimulation with protease-treated anti-EpCAM×anti-CD3 ProTIA triggered significant cytokine expression, especially at concentrations higher than 100 nM for all of the cytokines tested. In contrast, baseline levels of IL-2, IL-6, IL-10, TNF-alpha and IFN-gamma were detected when the intact non-cleaved anti-EpCAM×anti-CD3 ProTIA molecule was the stimulant at a concentration range of 10 to 2000 nM. While an appreciable level of IL-4 was detected when induced with the protease-untreated ProTIA, the level of IL-4 was, however, not higher than that observed with the protease-treated ProTIA (FIGS. 33-35). These data suggest that the XTEN polymer of the intact ProTIA composition provides considerable shielding effect and hinders PBMC stimulated cytokine responses compared to the protease-treated ProTIA in which the EpCAM×anti-CD3 portion is released from the composition.

Example 13: Anti-Tumor Properties of Anti-EpCAM×Anti-CD3 Protease Triggered Immune Activator (ProTIA) Composition in Early Treatment HCT-116 Model In vivo efficacy experiment was performed in immunodeficient NOD/SCID mice, characterized by the deficiency of T and B cells, and impaired natural killer cells. Mice were maintained in sterile, standardized environmental conditions and experiment performed in accordance with the Association for Assessment and Accreditation of Laboratory Animal Care (AAALAC) guidelines. The efficacy of protease-treated and protease-untreated anti-EpCAM×anti-CD3 ProTIA (e.g. AC1476) together with non-cleavable anti-Ep- CAMxanti-CD3 ProTIA (i.e. ProTIA without the release segment cleavage sequence and an example of which being AC1484) was evaluated using the human HCT-116 colorectal carcinoma xenograft model. Briefly, on day 0, four cohorts of 5 NOD/SCID mice per group were subcutaneously injected in the right flank with $5 \times 10^6$ human PBMC mixed with $5 \times 10^6$ HCT-116 cells. An hour after HCT-116/PBMC inoculation and based on equimolar dosing, cohort 1 was injected with vehicle (PBS+0.05% Tween 80), cohort 2 with 0.21 mg/kg protease-treated anti-EpCAMxanti-CD3 ProTIA, cohort 3 with 0.5 mg/kg protease-untreated anti-EpCAMxanti-CD3 ProTIA and cohort 4 with 0.49 mg/kg non-cleavable anti-EpCAMxanti-CD3 ProTIA. Cohort 1 to 4 were all subjected to four additional doses administered daily from day 1 to 4.

Tumors were measured twice per week for a projected 35 days with a caliper in two perpendicular dimensions and tumor volumes were calculated by applying the (width$^2 \times$ length)/2 formula. Body weight, general appearance and clinical observations such as seizures, tremors, lethargy, hyper-reactivity, pilo-erection, labored/rapid breathing, coloration and ulceration of tumor and death were also closely monitored as a measure of treatment related toxicity. Study endpoint was defined as a tumor volume of 12002000 mm$^3$ or survival to 35 days, whichever comes first. Percent tumor growth inhibition index (% TGI) was calculated for each of the treatment group by applying the formula: ((Mean tumor volume of PBS control–Mean tumor volume of ProTIA treatment)/mean tumor volume of PBS control)$\times$100. Treatment group with % TGI 60% is considered therapeutically active.

Figure 38:
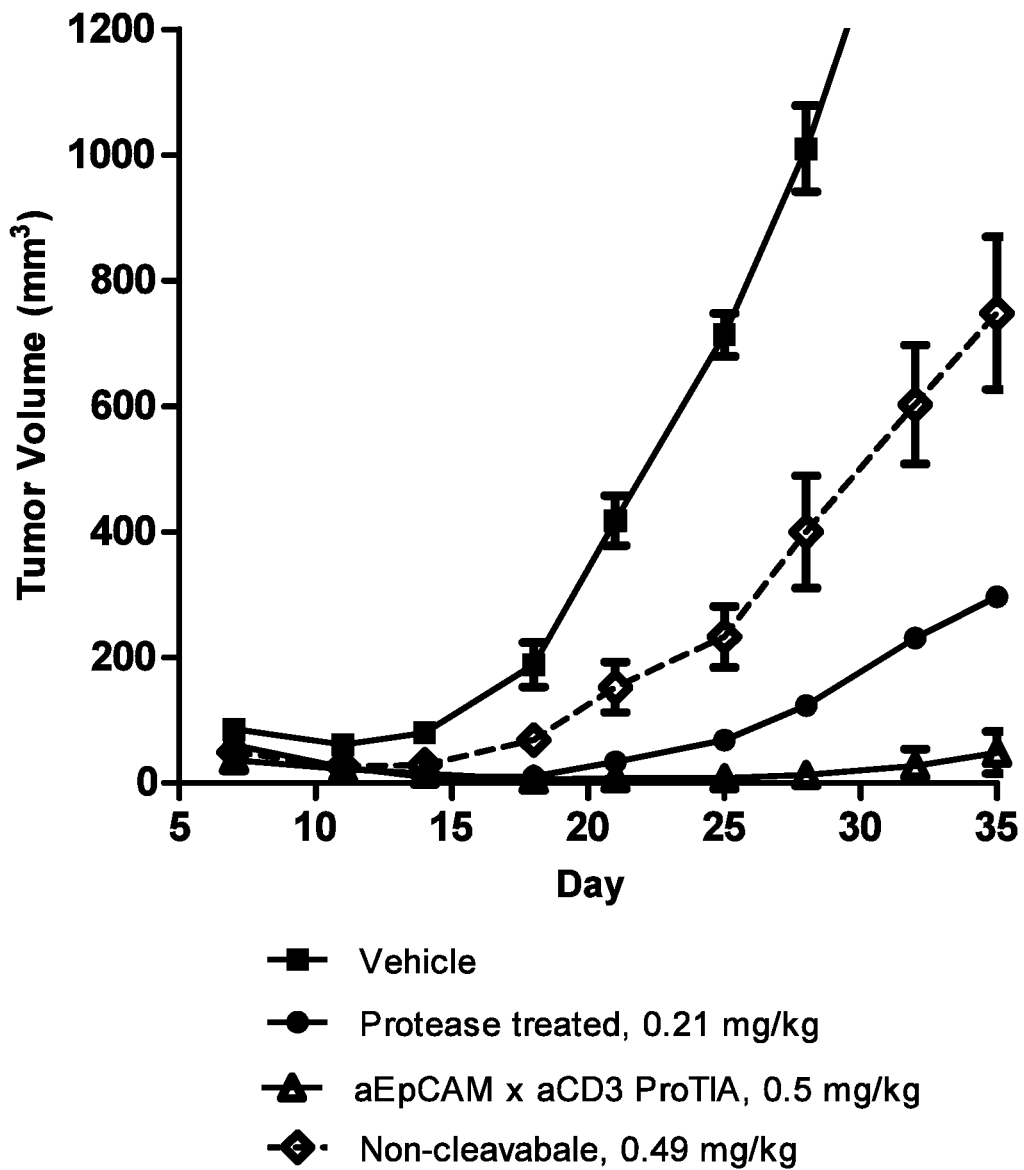
FIG. 38 depicts HCT-116 tumor volume results from experiment to determine the anti-tumor effect of anti-Ep-CAM×anti-CD3 ProTIA, protease-treated anti-EpCAM×anti-CD3 ProTIA and non-cleavable anti-EpCAM×anti-CD3 ProTIA, as described in Example 13.

At day 1835, cohort 1 mice treated with vehicle in the presence of human effector cells did not inhibit tumor progression and exiting the study with a group mean tumor volume of 1823 mm$^3$, demonstrating that human effector cells alone as such could not elicit an anti-tumor effect. Treatment with the protease-treated anti-EpCAMxanti-CD3 ProTIA at 0.21 mg/kg (cohort 2) in the presence of human effector cells exhibited robust suppression of tumor growth; with ⅔ mice exhibiting complete tumor regression by displaying no measureable tumor volume at day 18. However, tumor regrowth and progression was observed from day 25 onwards in this cohort resulting in all 5 mice bearing a tumor burden exiting the study with a mean tumor volume of 296 mm$^3$. Significantly, treatment with intact anti-EpCAMxanti-CD3 ProTIA at 0.5 mg/kg (cohort 3) in the presence of human effector cells also imparted strong inhibition of tumor growth. In fact ⅘ mice in cohort 3 exhibited complete tumor regression by day 18. On the other hand; with 2 mice still retaining complete regression on day 35 ensuing a cohort mean tumor volume of 48 mm$^3$ exiting the study. Importantly, Cohort 4 subjected to 0.49 mg/kg dose of non-cleavable anti-EpCAMxanti-CD3 ProTIA, did not induce any sustained inhibition of tumor progression as effectively as cohort 2 and 3, leaving 5/5 mice in this cohort with significant tumor burden by. Cohort 4 exited study at day 18.35 with a group mean tumor volume of 748 mm$^3$. Both protease-treated anti-EpCAMxanti-CD3 ProTIA at 0.21 mg/kg (cohort 2) and intact anti-EpCAMxanti-CD3 ProTIA at 0.5 mg/kg (cohort 3) are considered therapeutically active with a TGI of 84% and 97% respectively. With a TGI of 59%, the non-cleavable anti-EpCAMxanti-CD3 ProTIA is considered therapeutically inactive. As expected, the group mean tumor volume of intact anti-EpCAMxanti-CD3 ProTIA is found to be significantly different from that of non-cleavable anti-EpCAMxanti-CD3 ProTIA cohort (student's t-test, p=0.0016). Appreciably, the group mean tumor volume of intact anti-EpCAMxanti-CD3 ProTIA cohort is also found to be significantly different from that of protease-treated anti-EpCAMxanti-CD3 ProTIA cohort (p=0.002). Results suggest that at 0.5 mg/kg, significant amount of anti-EpCAMxanti-CD3 ProTIA was effectively cleaved by proteases present in the in vivo HCT-116 tumor environment to the highly active, unXTENylated anti-EpCAMxanti-CD3 moiety to impart the remarkable observed tumor regression. This hypothesis is very much supported by the non-cleavable anti-EpCAMxanti-CD3 ProTIA molecule lacking the release segment substrate that resulted in the lack of sustained tumor regression property (FIG. 38). Importantly, data also suggest that the anti-EpCAMxanti-CD3 ProTIA levied better therapeutic exposure than protease-treated anti-EpCAMxanti-CD3 ProTIA therefore reporting a more sustained tumor regression effect.

Figure 39:
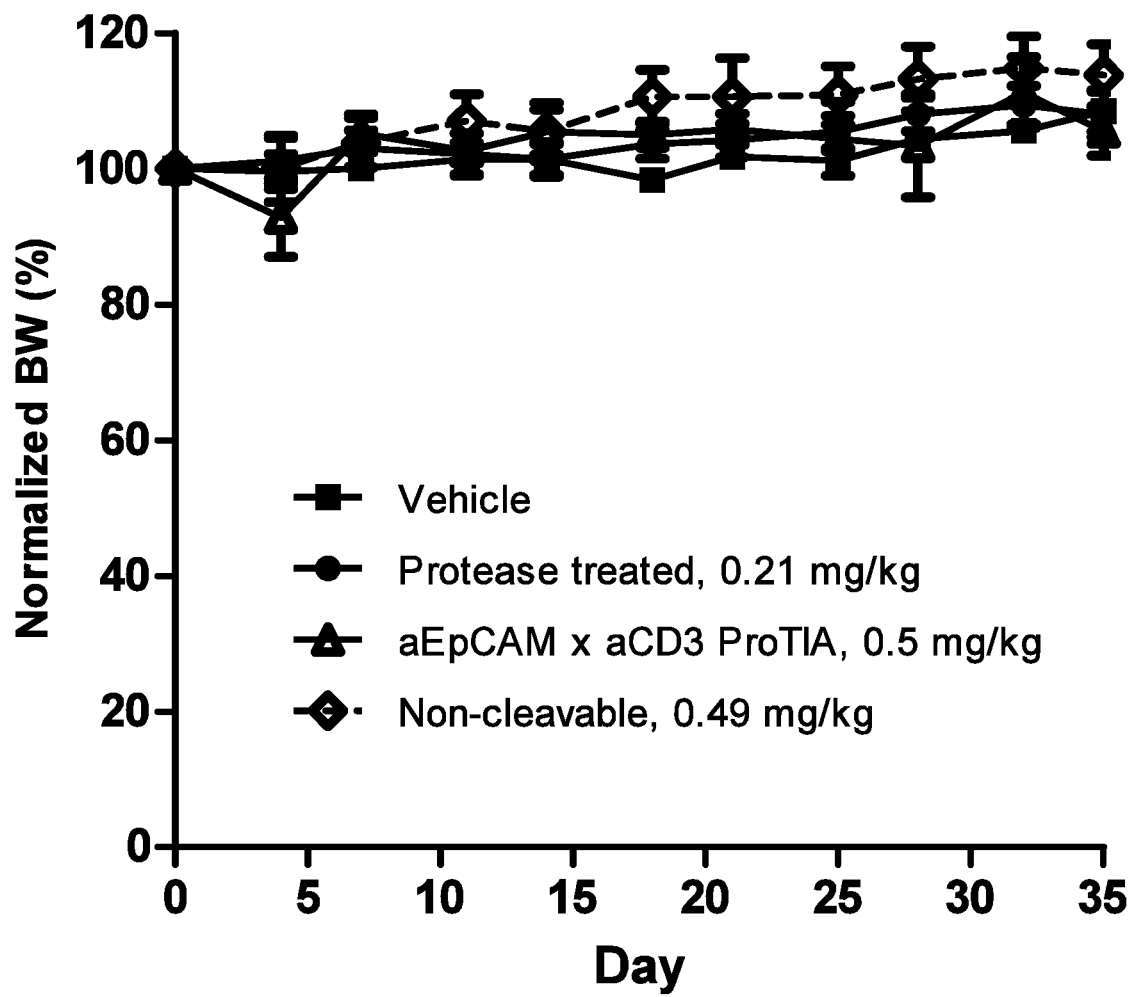
FIG. 39 depicts body weight results from experiment to determine the anti-HCT-116 tumor effect of anti-EpCAM×anti-CD3 ProTIA, protease-treated anti-EpCAM×anti-CD3 ProTIA and non-cleavable anti-EpCAM×anti-CD3 ProTIA, as described in Example 13.

Of note, no significant body weight loss was observed in all ProTIA treatment groups and vehicle control indicating that all treatments were generally well tolerated (FIG. 39).

Figure 40:
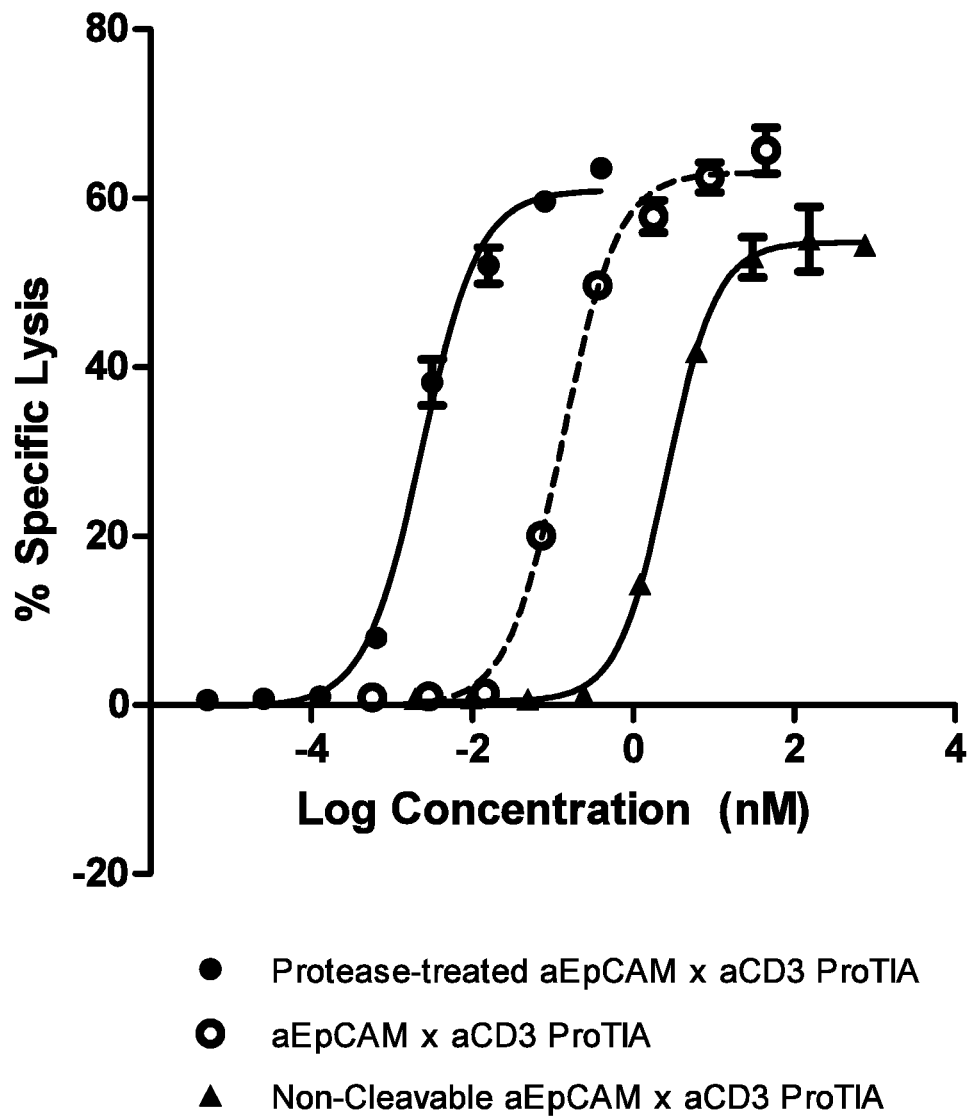
FIG. 40 depicts results from the experiment to determine the in vitro activity of protease-treated, protease-untreated and protease-non cleavable anti-EpCAM×anti-CD3 ProTIA in SK-OV-3 with human purified CD3 positive T cells as described in Example 14.
Figure 41:
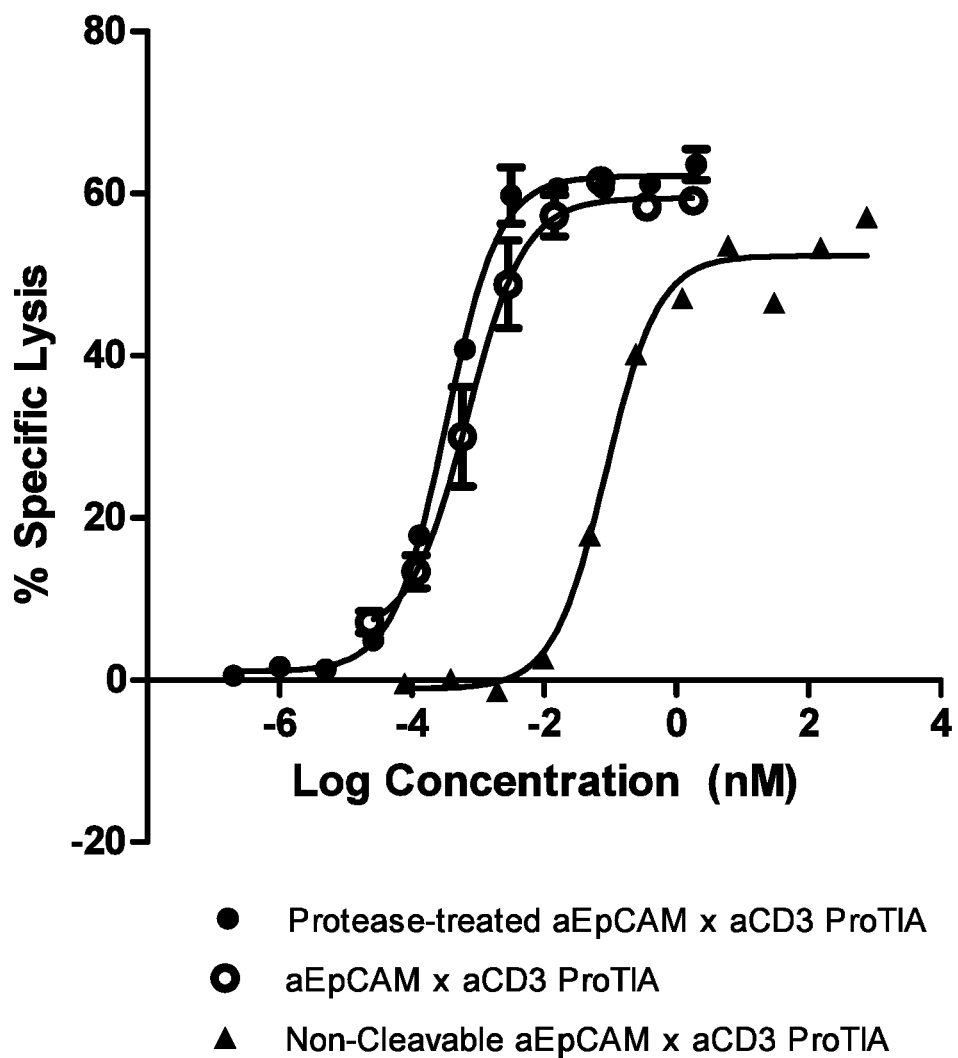
FIG. 41 depicts results from the experiment to determine the in vitro activity of protease-treated, protease-untreated and protease-non cleavable anti-EpCAM×anti-CD3 ProTIA in OVCAR-3 with human purified CD3 positive T cells as described in Example 14.

Example 14: Cytotoxicity Assays of Anti-EpCAMxAnti-CD3 Protease Triggered Immune Activator (ProTIA) Composition in the Presence of Purified CD3 Positive T Cells To demonstrate that cytotoxic activity of ProTIA molecules is mediated by CD3 positive T cells, non-cleavable anti-EpCAMxanti-CD3 ProTIA without the release segment (e.g. AC1484) and protease-treated and untreated anti-EpCAMxanti-CD3 ProTIA (e.g. AC1476) were further evaluated in SK-OV-3 and OVCAR-3 human ovarian cell lines in the presence of purified human CD3 positive T cells. Purified human CD3 positive T cells were purchased from BioreclamationIVT and isolated by negative selection using MagCellect Human CD3+ T cell isolation kit from whole blood of healthy donors. In this experiment, purified human CD3 positive T cells were mixed with SK-OV-3 or OVAR-3 ovarian cells in a ratio of 5:1 and all three ProTIA molecules were tested as a 12-point, 5x serial dilution dose curve in the LDH assay as described above. As expected, the activity trend of the three ProTIA molecules profiled in SK-OV-3 was found to be similar to that observed in the SK-OV-3 with PBMC analysis (FIG. 30). In the cytotoxic killing of SK-OV-3 ovarian cells by human CD3 positive T cells, untreated anti-EpCAMxanti-CD3 ProTIA is 56-fold less active than protease-treated ProTIA ($EC_{50}$ of 134 pM vs. 2.4 pM); and the non-cleavable anti-EpCAMxanti-CD3 ProTIA is >1000-fold less active than the protease-cleaved ProTIA ($EC_{50}$ of 2660 pM vs. 2.4 pM) (FIG. 40). In the cytotoxic killing of OVCAR-3 ovarian cells by human CD3 positive T cells, untreated anti-EpCAMxanti-CD3 ProTIA is only 2-fold less active than protease-treated ProTIA ($EC_{50}$ of 0.7 pM vs. 0.3 pM); and the non-cleavable anti-EpCAMxanti-CD3 ProTIA is 287-fold less active than the protease-cleaved ProTIA ($EC_{50}$ of 86 pM vs. 0.3 pM) (FIG. 41). Results demonstrated that cytotoxic activity of ProTIA molecules is indeed mediated by CD3 positive T cells; and that the susceptibility of the release segment contained within the cleavable anti-EpCAMxanti-CD3 ProTIA molecule to proteases postulated to be released from the tumor cells and/or activated CD3 positive T cells in the assay mixture is likely to differ between cell lines.

Example 15: T-Cell Activation Marker and Cytokine Release Assays of Anti-EpCAMxAnti-CD3 Protease Triggered Immune Activator (ProTIA) Composition To measure the anti-EpCAMxanti-CD3 ProTIA induced expression of cytokines, $1 \times 10^5$ purified CD3+ cells were co-cultured with 2×10⁴ SK-OV-3 cells per assay well (i.e., effector to target ratio of 5:1) in the presence of anti-EpCAM×anti-CD3 ProTIA in a 96-well round-bottom plate with total final volume of 200 microL. After 20 h incubation in a 37° C., 5% $CO_2$ humidified incubator, cell supernatant was harvested for cytokine measurements. This assay can also be performed with other target cells selected from HCT-116, Kato III, MDA-MB-453, MCF-7, MKN45, MT3, NCI-N87, SK-Br-3, SW480, OVCAR3 and PC3 cell lines as well as PBMC in place of purified CD3+ cells.

Cytokine analysis of interleukin (IL)-2, IL-4, IL-6, IL-10, tumor necrosis factor (TNF)-alpha and interferon (IFN)-gamma secreted into the cell culture supernatant was quantitated using the Human Th1/Th2 Cytokine Cytometric Bead Array (CBA) kit (BD Biosciences cat #550749) following manufacturer's instruction. In the absence of ProTIA, no cytokine secretion above background is expected from purified CD3+ cells. ProTIA in the presence of EpCAM-positive target cells and purified CD3+ cells is expected to activate T cells and secrete a pattern of T cell cytokines with a high proportion of Th1 cytokines such as IFN-gamma and TNF-alpha.

Figure 50A:
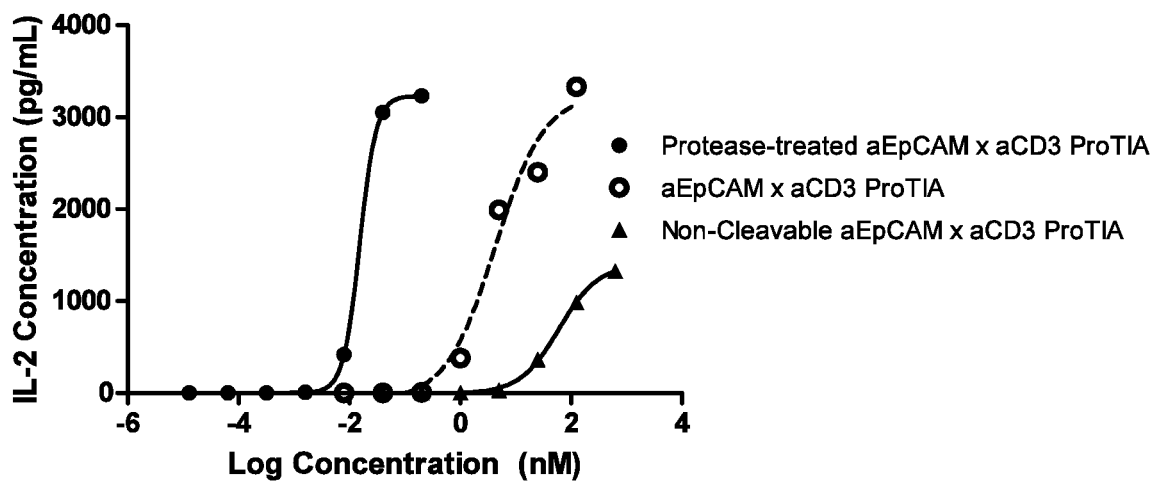
Figure 50B:
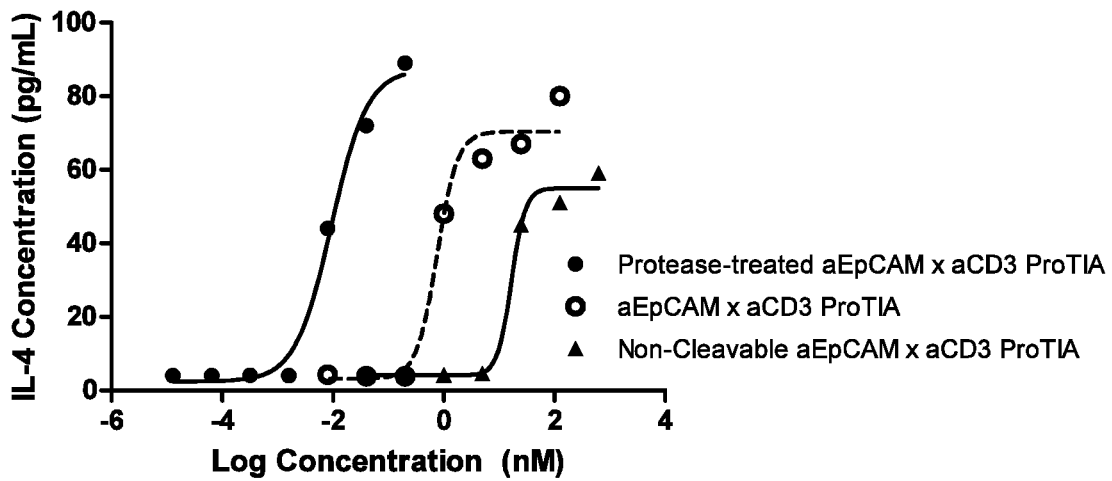
FIG. 50B depicts the concentration of released IL-4.
Figure 51A:
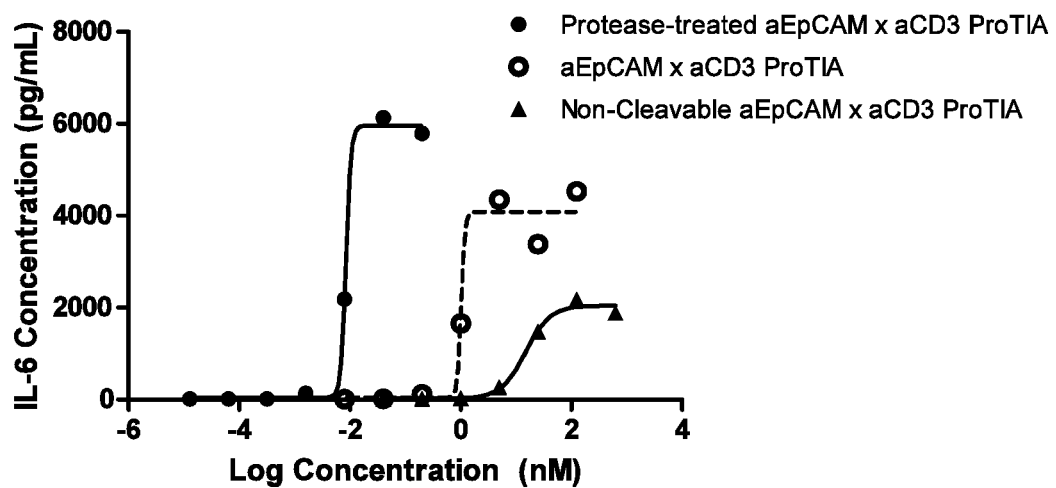
Figure 51B:
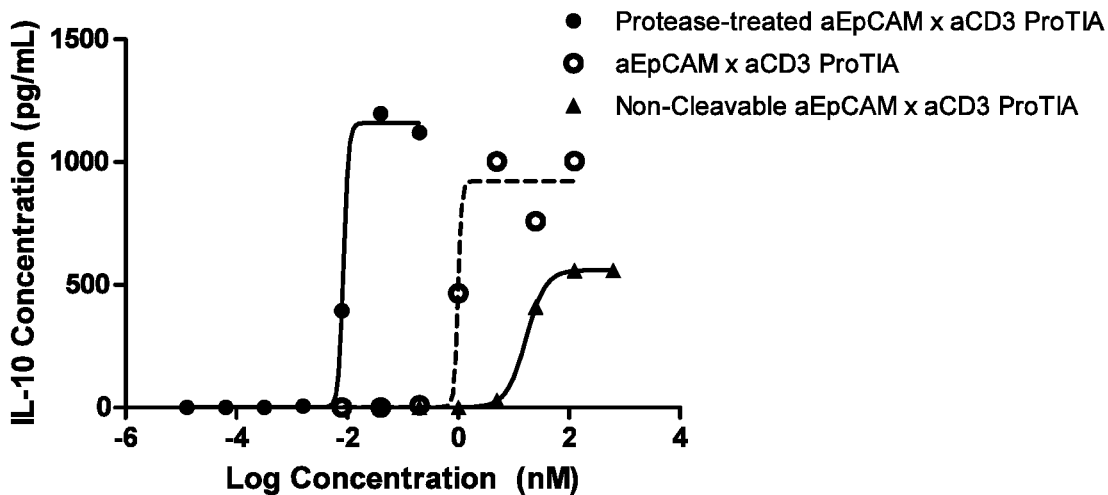
FIG. 51B depicts the concentration of released IL-10.
Figure 52A:
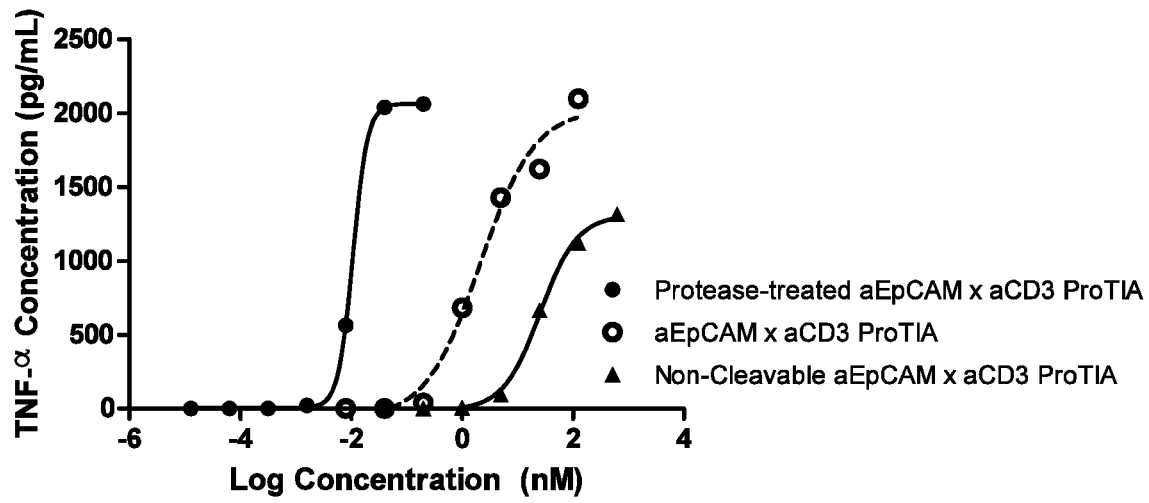
Figure 52B:
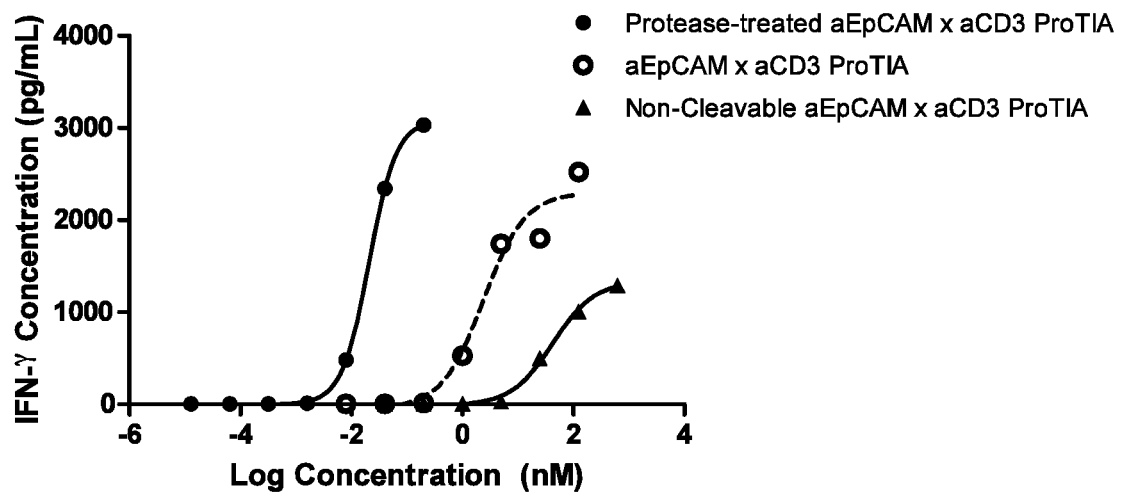
FIG. 52B depicts the concentration of released IFN-gamma.

As expected, anti-EpCAM×anti-CD3 ProTIA induced robust secretion of all cytokines (IL-2, IL-4, IL-6, IL-10, TNF-alpha, IFN-gamma) evaluated (see FIGS. 50-52). Stimulation of purified CD3+ cells with SK-OV-3 cells and protease-treated anti-EpCAM×anti-CD3 ProTIA triggered significant cytokine expression, especially at concentrations higher than 20 pM for all of the cytokines tested. In contrast, baseline levels of IL-2, IL-4, IL-6, IL-10, TNF-alpha and IFN-gamma were detected when the intact non-cleaved anti-EpCAM×anti-CD3 ProTIA molecule was used at a concentration range of 8 to 200 pM ($EC_{50}$ of 4.3 nM). Additionally, baseline levels of all cytokines tested were detected when the non-cleavable anti-EpCAM×anti-CD3 ProTIA molecule was used at a concentration range of 40 pM to 1 nM. These data suggest that the XTEN polymer of the intact ProTIA composition provides considerable shielding effect and hinders CD3+ T-cell stimulated cytokine responses compared to the protease-treated ProTIA in which the EpCAM×anti-CD3 portion is released from the composition.

Example 16: CD3 Binding Specificity of Anti-EpCAM×Anti-CD3 Protease Triggered Immune Activator (ProTIA) Composition As ProTIA is a bispecific-targeting composition, the binding capability of anti-EpCAM×anti-CD3 ProTIA composition was also evaluated for binding affinity to human CD3. This was determined with a CD3εδ/peroxidase-conjugated protein-L sandwich ELISA. In this ELISA, recombinant human CD3 (rhCD3εδ) (Creative BioMart cat #CD3E&CD3D-219H) was coated on a 96-well, flat-bottomed plate at a concentration of 0.025 microg/100 microL. After overnight incubation at 4° C., the assay plate was washed and blocked with 3% bovine serum albumin (BSA) for 1 h at room temperature. The plate was washed again followed by the introduction of dose ranges of non-cleavable anti-EpCAM×anti-CD3 ProTIA (e.g. AC1484), protease-treated and protease-untreated anti-EpCAM×anti-CD3 ProTIA (e.g. AC1476). The dose range utilized for all three versions of ProTIA was 0.002 to 100 nM, achieved with a 1:6 fold serial dilution scheme from a starting concentration of 100 nM. The plate was allowed to incubate with shaking for 1 h at room temperature to allow the non-cleavable, protease-cleaved and protease-untreated ProTIA to bind to the rhCD3εδ coated on the plate. Unbound components were removed with a wash step and a peroxidase-conjugated protein L (ThermoFisher Scientific cat #32420) at 0.05 microg/100 microL was added. After an appropriate incubation period, any unbound reagent was removed by a wash step followed by the addition of tetramethylbenzidine (TMB) substrate to each well. After desired color intensity was reached, 0.2 N sulfuric acid was added to stop the reaction and absorbance (OD) was measured at 450 nm using a spectrophotometer. The intensity of the color is proportional to the concentration of non-cleavable, protease-treated and untreated anti-EpCAM×anti-CD3 ProTIA captured by the rhCD3εδ/protein-L sandwich ELISA. The intensity of the color produced (measured OD) was plotted against protein concentration; and the concentration of non-cleavable, protease-cleaved and uncleaved anti-EpCAM×anti-CD3 ProTIA that gave half-maximal response ($EC_{50}$) was derived with a 4-parameter logistic regression equation using GraphPad prism software.

Figure 53:
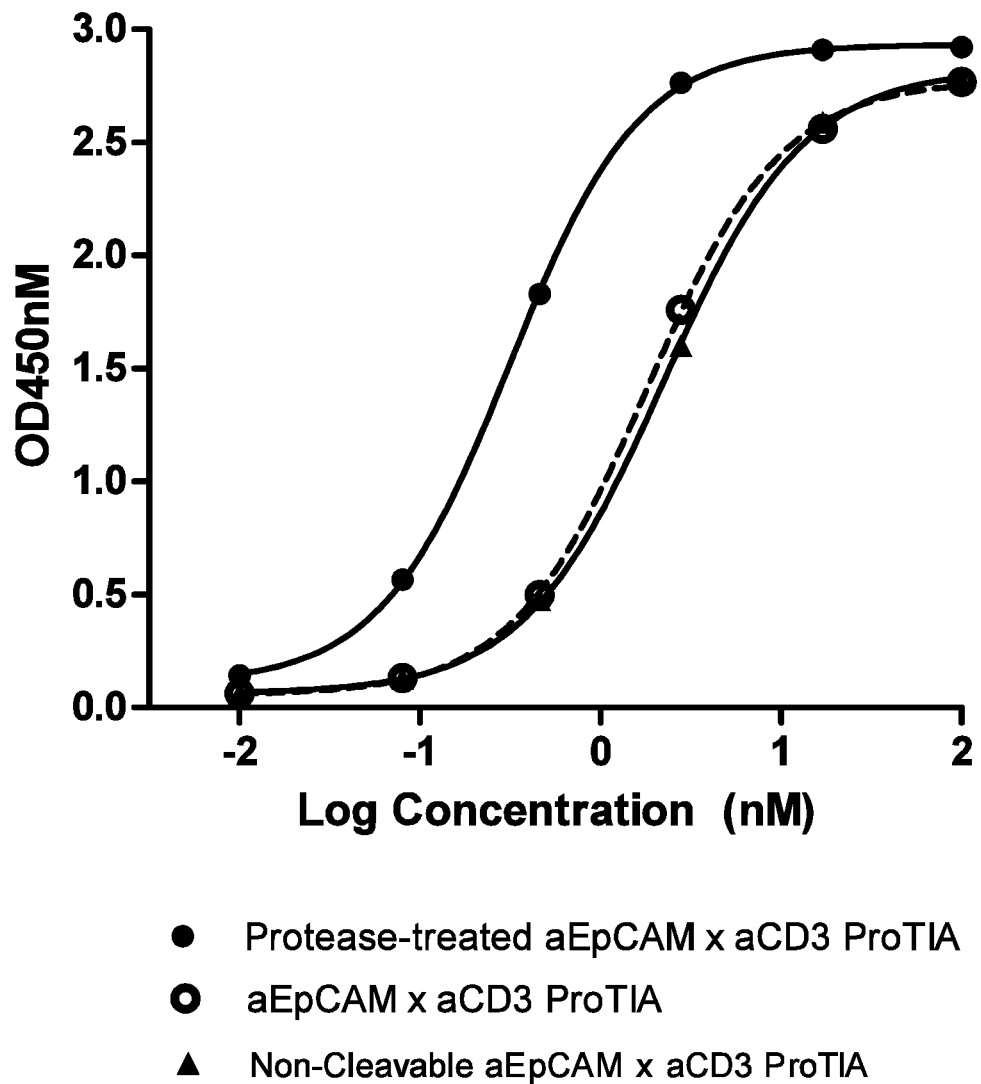
FIG. 53 shows the binding curves of protease-treated, protease-untreated and noncleavable antiEpCAM×antiCD3 ProTIA for CD3εδ ligands, as described in Example 16.

Results: As shown in FIG. 53, the protease-untreated anti-EpCAM×anti-CD3 ProTIA had a binding activity similar to that of non-cleavable anti-EpCAM×anti-CD3 bispecific ProTIA molecule each bearing an $EC_{50}$ of 1800 pM and 2200 pM respectively. The protease-treated ProTIA had the strongest binding activity at $EC_{50}$ of 310 pM for the rhCD3εδ ligand compared to the intact protease-untreated bispecific molecule or the non-cleavable ProTIA molecule. As the XTEN864 blocking moiety is located right after the anti-CD3scFv moiety, the XTEN864 results in hindrance in the binding of the non-cleaved anti-CD3 entity for its ligand by ~5.8 fold as compared to the cleaved and released anti-CD3scFv portion of the ProTIA binding to the CD3 ligand.

Example 17: Binding Specificity of Anti-EpCAM×Anti-CD3 Protease Triggered Immune Activator (ProTIA) Composition The binding specificity of an anti-EpCAM×anti-CD3 ProTIA (e.g. AC1476) was evaluated in conjunction with the control ProTIA compositions anti-CEA×anti-CD3 ProTIA (e.g. AC1432) and anti-HER2×anti-CD3 ProTIA (e.g. AC1408), in a target antigen/biotin-conjugated protein-L sandwich ELISA. Both the anti-CEA×anti-CD3 ProTIA (AC1432) and the anti-HER2×anti-CD3 ProTIA (AC1408) bear the same anti-CD3 scFv component as the anti-EpCAM×anti-CD3 ProTIA (AC1476) albeit with different targeting component. In the ELISA binding assay, recombinant human EpCAM (rhEpCAM) (R&D Systems cat #960-EP-50), recombinant human CEA (Abcam cat #ab742) and recombinant human HER2 (AcroBiosystems cat #HE2-H525) were coated on a 96-well, flat-bottomed plate at a concentration of 0.1 microg/100 microL. After overnight incubation at 4° C., the assay plate was washed and blocked with 3% bovine serum albumin (BSA) for 1 h at room temperature. The plate was washed again followed by the introduction of a dose range (0.0007 to 0.5 nM, achieved with a 1:3 fold serial dilution scheme from a starting concentration of 0.5 nM) of protease-treated anti-EpCAM×anti-CD3 ProTIA (e.g. AC1476) to EpCAM-coated wells, CEA-coated wells and HER2-coated wells. Serving as controls, protease-treated anti-CEA×anti-CD3 ProTIA (AC1432) was introduced at a similar dose range onto CEA-coated wells, and protease-treated anti-HER2×anti-CD3 ProTIA (AC1408) was also introduced at a similar dose range onto HER2-coated wells. The plate was allowed to incubate with shaking for 1 h at room temperature to allow the various protease-cleaved ProTIAs to bind to the respective antigen coated on the plate. Unbound components were removed with a wash step and a biotin-conjugated protein L (ThermoFisher Scientific cat #29997) was added at 0.05 microg/100 microL. After an appropriate incubation period, any unbound reagent was removed by a wash step followed by the addition of tetramethylbenzidine (TMB) substrate to each well. After desired color intensity was reached, 0.2 N sulfuric acid was added to stop the reaction and absorbance (OD) was measured at 450 nm using a spectrophotometer. The intensity of the color is proportional to the concentration of the respective protease-treated ProTIAs captured by the appropriate antigen coated on the plate. The intensity of the color produced (measured OD) was plotted against ProTIA concentration; and the respective dose curve derived with a 4-parameter logistic regression equation using GraphPad prism software.

Figure 54:
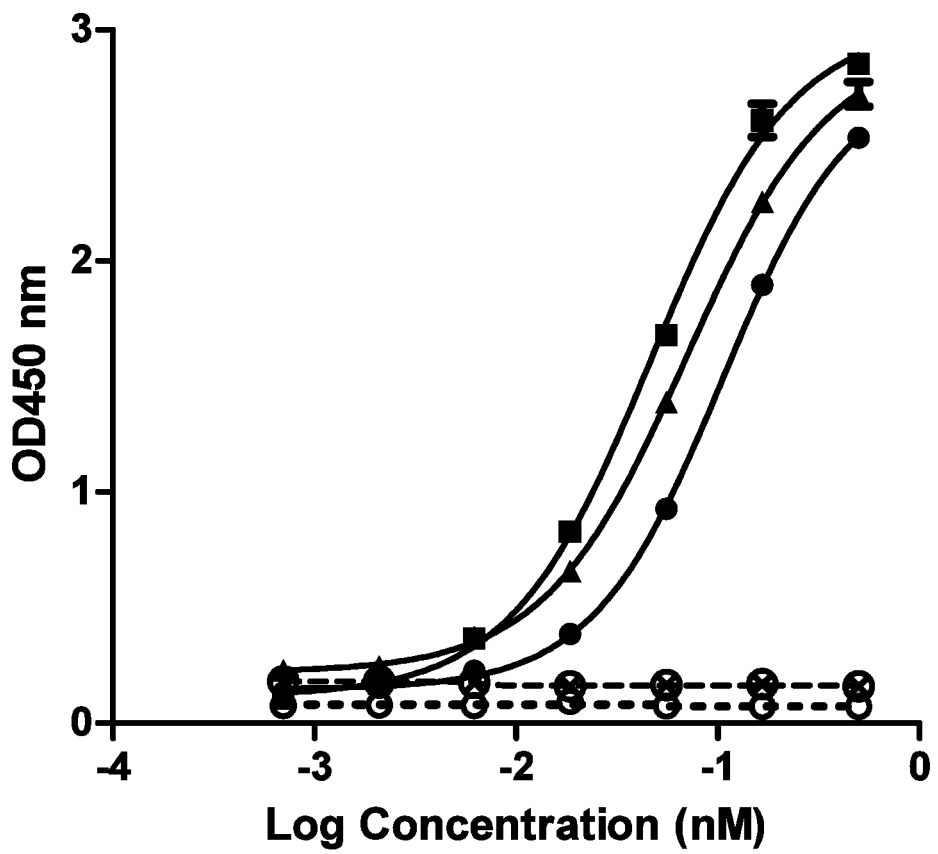
FIG. 54 shows binding specificity of protease treated antiEpCAM×antiCD3 ProTIA for rhEpCAM ligand, as described in Example 17.

Results: As shown in FIG. 54 (and comparable with the results of FIG. 24), protease-treated anti-EpCAM×anti-CD3 ProTIA binds to rhEpCAM coated on the plate in a dose-dependent manner to yield an $EC_{50}$ of 110 pM. Similarly, protease-treated anti-CEA×anti-CD3 ProTIA binds to the CEA antigen coated on the plate in a dose-dependent manner to yield an $EC_{50}$ of 70 pM; and protease-treated anti-HER2×anti-CD3 ProTIA binds to the HER2 antigen coated on the plate in a dose-dependent manner to yield an $EC_{50}$ of 47 pM. Significantly, no dose-dependent binding was observed for protease-treated anti-EpCAM×anti-CD3 ProTIA binding to both CEA- and HER2-antigen coated on the plate indicating that protease-treated anti-EpCAM×anti-CD3 ProTIA binds specifically to EpCAM but not to CEA or HER2 antigen. Thus, the compositions exhibited specific binding affinity to their target ligands and no non-specific binding.

Example 18: Anti-Tumor Properties of Intact Anti-EpCAM×Anti-CD3 ProTIA Versus Non-Cleavable Anti-EpCAM×Anti-CD3 ProTIA in Early Treatment SW480 Model The protease susceptibility of the release segment (RS) as engineered into the anti-EpCAM×anti-CD3 ProTIA molecule (e.g. AC1476) in tumor environment was also evaluated in vivo together with non-cleavable anti-EpCAM×anti-CD3 ProTIA (e.g. AC1484), protease-treated and protease-untreated anti-EpCAM×anti-CD3 ProTIA (e.g. AC1476) in the SW480/PBMC inoculated NOD/SCID xenograft model. Much like the study described in Examples 10 and 13, an hour after SW480/PBMC inoculation (denoted as day 0), cohort 1 mice was injected with vehicle (PBS 0.05% Tween 80), cohort 2 with 0.21 mg/kg protease-treated anti-EpCAM×anti-CD3 ProTIA, cohort 3 with 0.5 mg/kg intact anti-EpCAM×anti-CD3 ProTIA and cohort 4 with 0.49 mg/kg non-cleavable anti-EpCAM×anti-CD3 ProTIA. All cohorts (i.e. 1 to 4) were further treated with four additional doses administered daily from day 1 to day 4. Tumor volume, body weight and clinical observations are monitored two times per week for a targeted 35 days.

Figure 55:
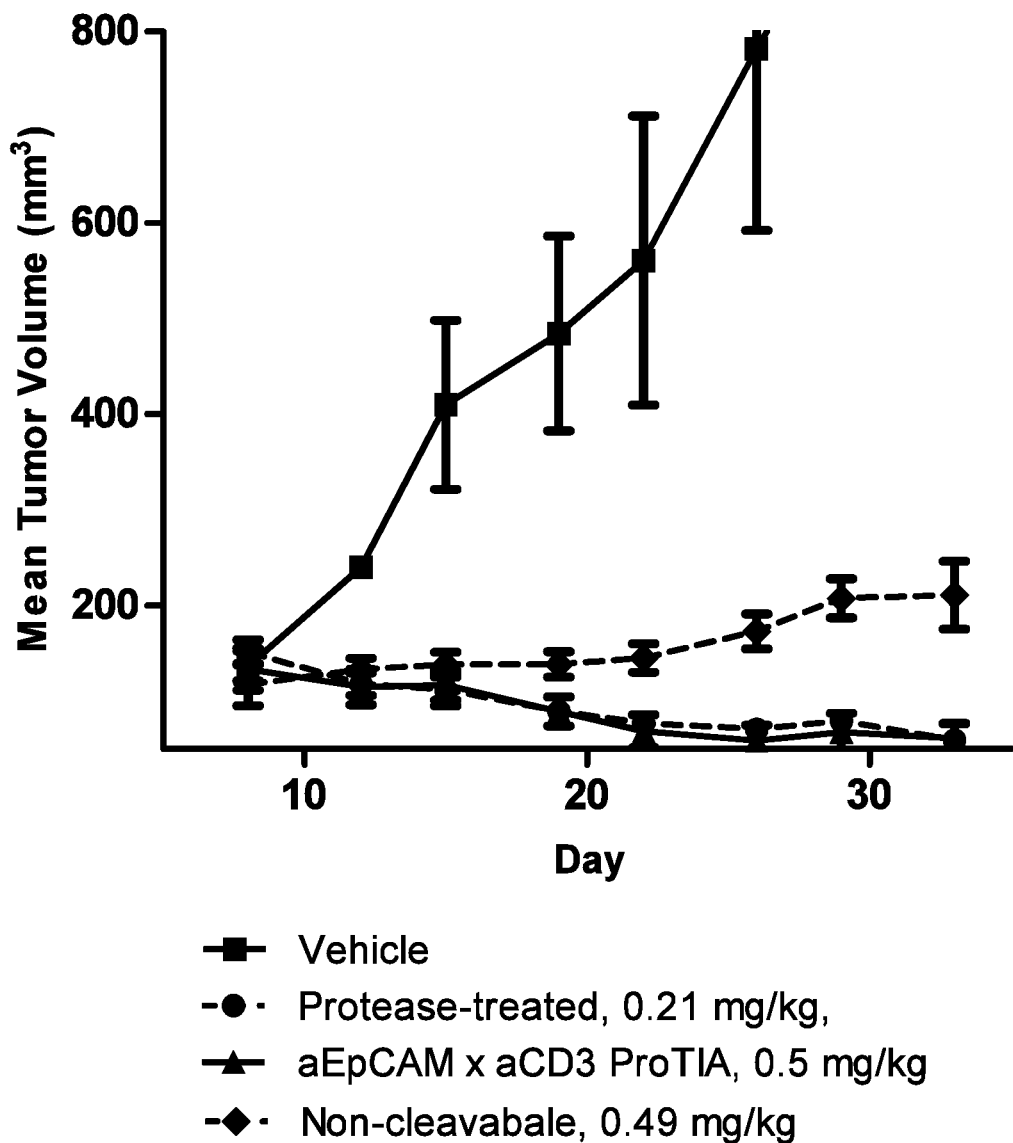
FIG. 55 depicts SW480 tumor volume results from the experiment to determine the antitumor effect of antiEp-CAM×antiCD3 ProTIA, protease treated antiEpCAM×antiCD3 ProTIA and noncleavable antiEpCAM×antiCD3 ProTIA, as described in Example 18.

As shown in FIG. 55, protease-treated anti-EpCAM×anti-CD3 ProTIA at 0.21 mg/kg (cohort 2), intact anti-EpCAM×anti-CD3 ProTIA at 0.5 mg/kg (cohort 3) and non-cleavable anti-EpCAM×anti-CD3 ProTIA at 0.49 mg/kg (cohort 4) are all determined to be therapeutically active with a tumor growth inhibition index (% TGI) of 93%, 95% and 80% respectively. Thus, dosed at equimolar, intact anti-EpCAM×anti-CD3 ProTIA is effectively cleaved by tumor-enriched proteases to the highly active released anti-EpCAM×anti-CD3 (not linked to the XTEN moiety) to display equivalent tumor regression efficacy as protease-treated anti-EpCAM×anti-CD3 ProTIA. As expected, though efficacious in inhibiting tumor progression, the non-cleavable anti-EpCAM×anti-CD3 ProTIA is less effective than intact anti-EpCAM×anti-CD3 ProTIA indicating that the presence of the release segment improved therapeutic efficacy of the composition by permitting the release of the anti-EpCAM×anti-CD3 binding domains.

Figure 56:
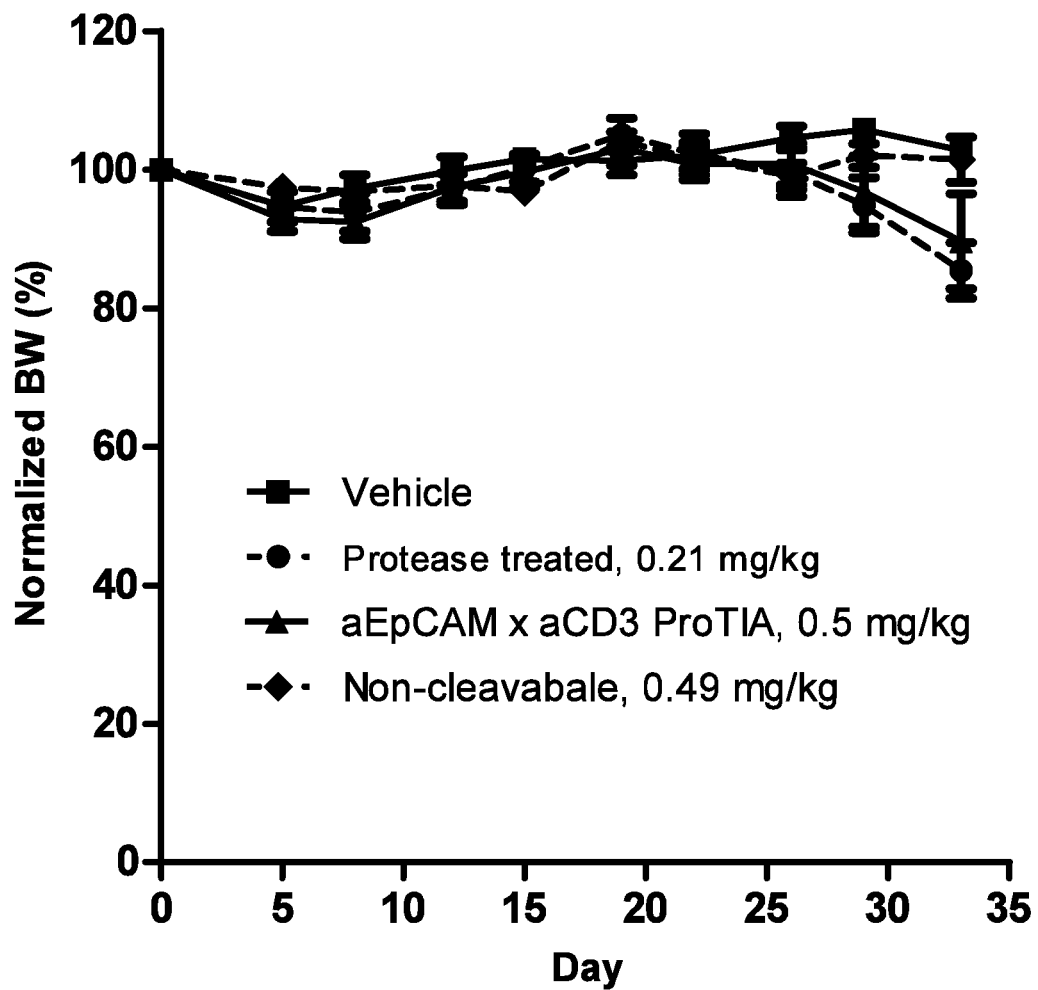
FIG. 56 depicts body weight results from the experiment to determine the antiSW480 tumor effect of antiEpCAM×antiCD3 ProTIA, protease-treated antiEpCAM×antiCD3 ProTIA and noncleavable antiEpCAM×antiCD3 ProTIA, as described in Example 18.

As shown in FIG. 56, some body weight loss was observed in cohort 2 and 3 in the SW480 xenograft model, suggesting some possible toxicity. Additional experiments evaluating minimum effective dose, reduced number of dosing and evaluation in established tumor model will shed more light on this initial observation.

Example 19: Anti-Tumor Properties of Anti-EpCAM×Anti-CD3 Protease Triggered Immune Activator (ProTIA) Composition in OVCAR-3 Ovarian Model The in vivo efficacy of anti-EpCAM×anti-CD3 ProTIA is also evaluated using the human ovarian OVCAR-3 cell line implanted intraperitoneally into the severely immunodeficient NSG (NOD.Cg-Prkdc$^{scid}$.IL2rg$^{tm1Wjl}$/SzJ) or NOG (NOD/Shi-scid/IL-2Rγ$^{null}$) mice. NOG and NSG mice are characterized by the deficiency of T, B and NK cells, as well as the dysfunction of macrophages, dendritic cell and complement system. Briefly, on day 0, seven cohorts of 5 NOG or NSG mice per group are implanted intraperitoneally with 5-10×10$^6$ OVCAR-3 cells, followed by the intravenous introduction of 5-10×10$^6$ of PBMC on day 14. On day 16, treatment is initiated with cohort 1 injected with vehicle (PBS+0.05% Tween 80) daily for 5 doses (qdx5), cohort 2 with 0.21 mg/kg protease-treated anti-EpCAM×anti-CD3 ProTIA qdx5, cohort 3 with 1.05 mg/kg protease-treated anti-EpCAM×anti-CD3 ProTIA once per week (qw), cohort 4 with 0.5 mg/kg with protease-untreated anti-EpCAM×anti-CD3 ProTIA qdx5, cohort 5 with 2.5 mg/kg with protease-untreated anti-EpCAM×anti-CD3 ProTIA qw, cohort 6 with 0.49 mg/kg non-cleavable anti-EpCAM×anti-CD3 ProTIA qdx5 and cohort 7 with 2.45 mg/kg non-cleavable anti-EpCAM×anti-CD3 ProTIA qw. All cohorts are subjected to another cycle of treatment the following week. Mice are monitored daily for behavior and survival, and twice weekly for body weight and abdomen distention. Blood are collected on day 30, day 40, day 50 and day 60 for CA125 determination as sign of tumor development. When weight of animals has increased by 30% from day 0, the animal is defined as having met study endpoint and is sacrificed and autopsied.

Growth of OVCAR-3 tumor is evidenced by the development of intraperitoneal ascites as monitored by increase in body weight, increase in abdomen diameter and an increase in circulating CA125 levels. It is expected that both protease-cleaved and protease-untreated anti-EpCAM×anti-CD3 ProTIA (e.g. AC1476) will lead to improve survival and an absence or delay of ascites formation. It is also expected that the protease-untreated ProTIA will have a better therapeutic exposure leading to a more efficacious anti-tumor effect and better safety profile than protease-treated ProTIA. The non-cleavable anti-EpCAM×anti-CD3 ProTIA is also expected to retard tumor growth but to a much lesser extent than that demonstrated by the release segment bearing protease-untreated and the protease-treated ProTIA.

Example 20: PK Properties of Anti-EpCAM×Anti-CD3 Protease Triggered Immune Activator (ProTIA) Composition in OVCAR-3 Ovarian Model Protease-cleaved, protease-untreated and non-cleavable anti-EpCAM×anti-CD3 ProTIAs' PK and bio-distribution profile is evaluated as a mixture of independently metal-labeled molecules in the OVCAR-3 tumor bearing BALB/c nude mice. To each irradiated BALB/c nude mice, ten million OVCAR-3 cells are injected intraperitoneally on day 0. Treatment is initiated when abdominal distention is visibly observed and/or when animal body weight has increased by 10-15% over day 0. Out of twenty OVCAR-3 tumor bearing mice, 18 are selected and randomized according to their individual body weight into 2 groups of 9 animals per group. One group of 9 mice is intravenously injected with 1.5 mg/kg of the mixture comprising of equimolar concentration of metal 1-labeled protease-cleaved anti-EpCAM×anti-CD3 ProTIA, metal 2-labeled protease-untreated anti-EpCAM×anti-CD3 ProTIA and metal 3-labeled non-cleavable anti-EpCAM×anti-CD3 ProTIA. The other group of 9 animals is administered intraperitoneally with 1.5 mg/kg of the same ProTIA mixture.

By alternating between animals in the same group (i.e. intravenously and intraperitoneal administered groups), blood is collected by jugular/mandibular vein puncture into lithium heparin tubes at 0.5 h, 4 h, 8 h, 24 h, 48 h, day 3, day 5 and day 7 post-test article administration. Blood is processed into plasma by centrifugation at 1300 g for 10 minutes at 4° C. and stored at −80° C. till analysis.

Ascites is collected from both intravenously and intraperitoneal administered groups at 4 h, 8 h, 24 h, 48 h, day 3, day 5 and day 7 post-test article administrations by alternating between animals in the same group. Ascites samples are immediately centrifuged at 300 g for 10 minutes at 4° C. and fluid component frozen down at −80° C. until analysis.

Three mice from each group will be terminated on day 3, day 5 and day 7. Organs (brain, heart, liver, lung, spleen, and pancreas) and tumor nodules in the peritoneal cavity are harvested, weighed, flash frozen and stored at −80° C. until analysis is performed.

All samples (blood, ascites, normal organs and tumor tissues) are analyzed by ICP-MS (inductively coupled plasma mass spectrometry). In the intravenous arm, low amount of all 3 ProTIAs are expected to be detected in the ascites. In the plasma component, metal 2-labeled protease-untreated anti-EpCAM×anti-CD3 ProTIA and metal 3-labeled non-cleavable anti-EpCAM×anti-CD3 ProTIA are expected to demonstrate a longer systemic half-life than metal 1-labeled protease-cleaved anti-EpCAM×anti-CD3 ProTIA. In the intraperitoneal arm, all 3 ProTIA versions are expected to be detectable in the ascites with metal 2-labeled protease-untreated anti-EpCAM×anti-CD3 ProTIA and metal 3-labeled non-cleavable anti-EpCAM×anti-CD3 ProTIA having a longer retention time in the peritoneal cavity as compared to metal 1-labeled protease-cleaved anti-EpCAM×anti-CD3 ProTIA. It is also expected that metal 2-labeled protease-untreated anti-EpCAM×anti-CD3 ProTIA will have a shorter intraperitoneal half-life than metal 3-labeled non-cleavable anti-EpCAM×anti-CD3 ProTIA due to cleavage by proteases found in the tumor-loaded intraperitoneal environment. Metal 2-labeled protease-untreated anti-EpCAM×anti-CD3 ProTIA and metal 3-labeled non-cleavable anti-EpCAM×anti-CD3 ProTIA will be minimally detected in plasma at early time points indicating little leakage of intraperitoneally administered molecules into systemic circulation. All 3 ProTIA versions are expected to be present in tumor nodules extracted from the peritoneal cavity but not in normal organs.

Example 21: Anti-Tumor Properties of Anti-EpCAM×Anti-CD3 Protease Triggered Immune Activator (ProTIA) Composition in SK-OV-3 Ovarian Model The in vivo efficacy of anti-EpCAM×anti-CD3 ProTIA is also evaluated using the human ovarian SK-OV-3 cell line implanted intraperitoneally into the severely immunodeficient NSG (NOD.Cg-Prkdc$^{scid}$.IL2rg$^{tm1Wjl}$/SzJ) or NOG (NOD/Shi-scid/IL-2Rγ$^{null}$) mice. NOG and NSG mice are characterized by the deficiency of T, B and NK cells, as well as the dysfunction of macrophages, dendritic cell and complement system. Briefly, on day 0, seven cohorts of 5 NOG or NSG mice per group are implanted intraperitoneally with 5-10×10$^6$ SK-OV-3 cells, followed by the intraperitoneal introduction of 5-10×10$^6$ of PBMC on day 5. On day 7, treatment is initiated with cohort 1 injected with vehicle (PBS+0.05% Tween 80) daily for 5 doses (qdx5), cohort 2 with 0.21 mg/kg protease-treated anti-EpCAM×anti-CD3 ProTIA qdx5, cohort 3 with 1.05 mg/kg protease-treated anti-EpCAM×anti-CD3 ProTIA once per week (qw), cohort 4 with 0.5 mg/kg with protease-untreated anti-EpCAM×anti-CD3 ProTIA qdx5, cohort 5 with 2.5 mg/kg with protease-untreated anti-EpCAM×anti-CD3 ProTIA qw, cohort 6 with 0.49 mg/kg non-cleavable anti-EpCAM×anti-CD3 ProTIA qdx5 and cohort 7 with 2.45 mg/kg non-cleavable anti-EpCAM×anti-CD3 ProTIA qw. Mice are monitored daily for behavior and survival, and twice weekly for body weight and abdomen distention. When weight of animals has increased by 30% from day 0, animal is defined as having met study endpoint and are sacrificed and autopsied.

Growth of SK-OV-3 is evidenced by the development of intraperitoneally ascites monitored by increase in body weight and increase in abdomen diameter. It is expected that both protease-cleaved and protease-untreated anti-EpCAM×anti-CD3 ProTIA (e.g. AC1476) will lead to improve survival and absence or delay of ascites formation. It is also expected that the protease-untreated ProTIA will impart better therapeutic exposure, a more efficacious anti-tumor effect and better safety profile than protease-treated ProTIA. The non-cleavable anti-EpCAM×anti-CD3 ProTIA is also expected to retard tumor growth but to a much lesser magnitude than that exhibited by the release segment bearing protease-untreated ProTIA and the protease-treated ProTIA.

Example 22: Performance of Anti-EpCAM×Anti-CD3 Protease Triggered Immune Activator (ProTIA) Composition in Human Malignant Ascites Samples Human malignant ascites are collected from patients with primary intraperitoneal EpCAM positive epithelial malignancies which includes but not limited to advanced, relapsed and refractory ovarian (adenocarcinoma and mucinous), colorectal, gastric, bile duct/cholangiocarcinoma, Ampulla of Vater, pancreatic and non-clear renal cell carcinoma patients. Patients who are receiving chemotherapy, immunological therapy, biologics and/or corticosteroid therapy within the last 30 days prior to sample collection are excluded. Malignant ascites are centrifuged at 300-400 g for 10 min at room temperature and the fluid and pellet component harvested. The concentration of human proteases including but not limited to MMP-9, MMP-2, matriptase and uPA are quantitated in the fluid component using commercially available ELISA kits (human MMP-9, Invitrogen cat #KHC3061 or equivalent; human MMP-2, Invitrogen cat #KHC3081 or equivalent; human matriptase, Enzo cat #ADI-900-221; and human uPA, Abcam cat #119611) following manufacturer's instructions. The rate of intact anti-EpCAM×anti-CD3 (e.g. AC1476) cleavage by protease found in the ascites fluid is determined by spiking a known concentration of the ProTIA into the ascites fluid component and incubating mixture at 37° C., with an aliquot withdrawn at indicated time points of 0.5 h, 2 h, 4 h, 8 h, 24 h, 48 h, 3 day, 4 day, 5 day and 7 day. The amount of intact anti-EpCAM×anti-CD3 ProTIA present at the respective time points are then analyzed on a rhEpCAM/biotinylated-anti-XTEN sandwich ELISA with intact anti-EpCAM×anti-CD3 as standard.

Briefly, ELISA plate (Nunc Maxisorp cat #442404) is coated with 0.1 mircog/100 microL per well of rhEpCAM (R&D Systems, cat #EHH104111). After overnight incubation at 4° C., the ELISA plate is washed and blocked with 3% BSA for 1 h at room temperature. The plate is washed again followed by the appropriate addition of a dose range of intact, protease-untreated anti-EpCAM×anti-CD3 ProTIA standards, appropriate quality controls and ProTIA-spiked ascites test samples. The plate is allowed to incubate with shaking for 1 h at room temperature to allow the ProTIA standards, quality controls and test samples to bind to rhEpCAM coated on the plate. Unbound components are removed with several washes. Biotinylated anti-XTEN antibody (Amunix proprietary antibody) is added at 0.1 microg/100 microL and the plate allowed to incubate at room temperature for 1 h. After washing away unbound biotinylated reagent, streptavidin-HRP (ThermoFisher Scientific cat #21130) is added at 1:30,000 dilution and plate incubated at room temperature for 1 h. After several washes, TMB substrate is added to each well. Once desired color intensity is reached, 0.2 N sulfuric acid is added to stop the reaction and absorbance (OD) is measured at 450 nm using a spectrophotometer. The intensity of the color is proportional to the concentration of intact ProTIA captured by the rhEpCAM/biotinylated-anti-XTEN sandwich ELISA. The concentration of intact ProTIA present in the ascites test samples is determined against the intact ProTIA standard curve using the SoftMax Pro software. The rate of decrease of intact ProTIA as detected in the rhEpCAM/biotinylated-anti-XTEN sandwich ELISA (i.e. half-life) is determined using GraphPad Prism.

The ascites pellet is phenotyped for EpCAM, CD3, CD4, CD8, CA125 and CD56 expression. Malignant ascites samples tested positive for EpCAM and CD3 are used for cytotoxic analysis with protease-treated and protease-untreated ProTIA. Briefly, $1\times10^5$ ascites cells are reconstituted with appropriate amount of ascites fluid and allowed to adhere on a 24-well plate for 24 h in triplicate. Cells are treated with dose concentrations of protease-treated and intact anti-EpCAM×anti-CD3 ProTIA for 48 h, followed by quantitation of caspase 3/7 using a luminogenic caspase 3/7 substrate as instructed by manufacturer (Promega Caspase-Glo 3/7 cat #G8091). With luminescence signal being proportional to caspase-3/7 activity, dose concentration of protease-treated and untreated anti-EpCAM×anti-CD3 ProTIA is then plotted against luminescence signal and the concentration of protein that give half maximal response ($EC_{50}$) is derived with a 4-parameter logistic regression equation using GraphPad prism software. It is expected that the human malignant ascites derived from advanced, relapsed and refractory EpCAM positive cancer patients will contain all necessary components for the cleavage and subsequent activation of intact anti-EpCAM×anti-CD3 ProTIA to the unXTENylated anti-EpCAM×anti-CD3 moiety that exert strong cytotoxic activity. A decrease in number of EpCAM positive cells as a sign of tumor elimination; and an increase in T cell activation markers such as CD69 and granzymes as reflective of T cell activation are also expected, Example 23: Caspase 3/7 Assay of Anti-EpCAM×Anti-CD3 Protease Triggered Immune Activator (ProTIA) Composition Redirected cellular cytotoxicity of anti-EpCAM×anti-CD3 ProTIA compositions was also assessed via caspase 3/7 activities of apoptotic cells. Similar to the LDH cytotoxicity assay described above, PBMC or purified CD3 positive T cells were mixed with EpCAM positive tumor target cells such as SW480, SK-OV-3 and OVAR-3 cells in a ratio of 5 effectors to 1 target, HCT-116 at a ratio of 10:1; and all three ProTIA versions were tested as a 12-point, 5× serial dilution dose concentrations as in the LDH assay described above.

Upon cell lysis, released caspase 3/7 in culture supernatants was measured by the amount of luminogenic caspase 3/7 substrate cleavage by caspase 3/7 to generate the "glow-type" luminescent signal (Promega Caspase-Glo 3/7 cat #G8091). The amount of luminescence is proportional to the amount of caspase activities.

Figure 57:
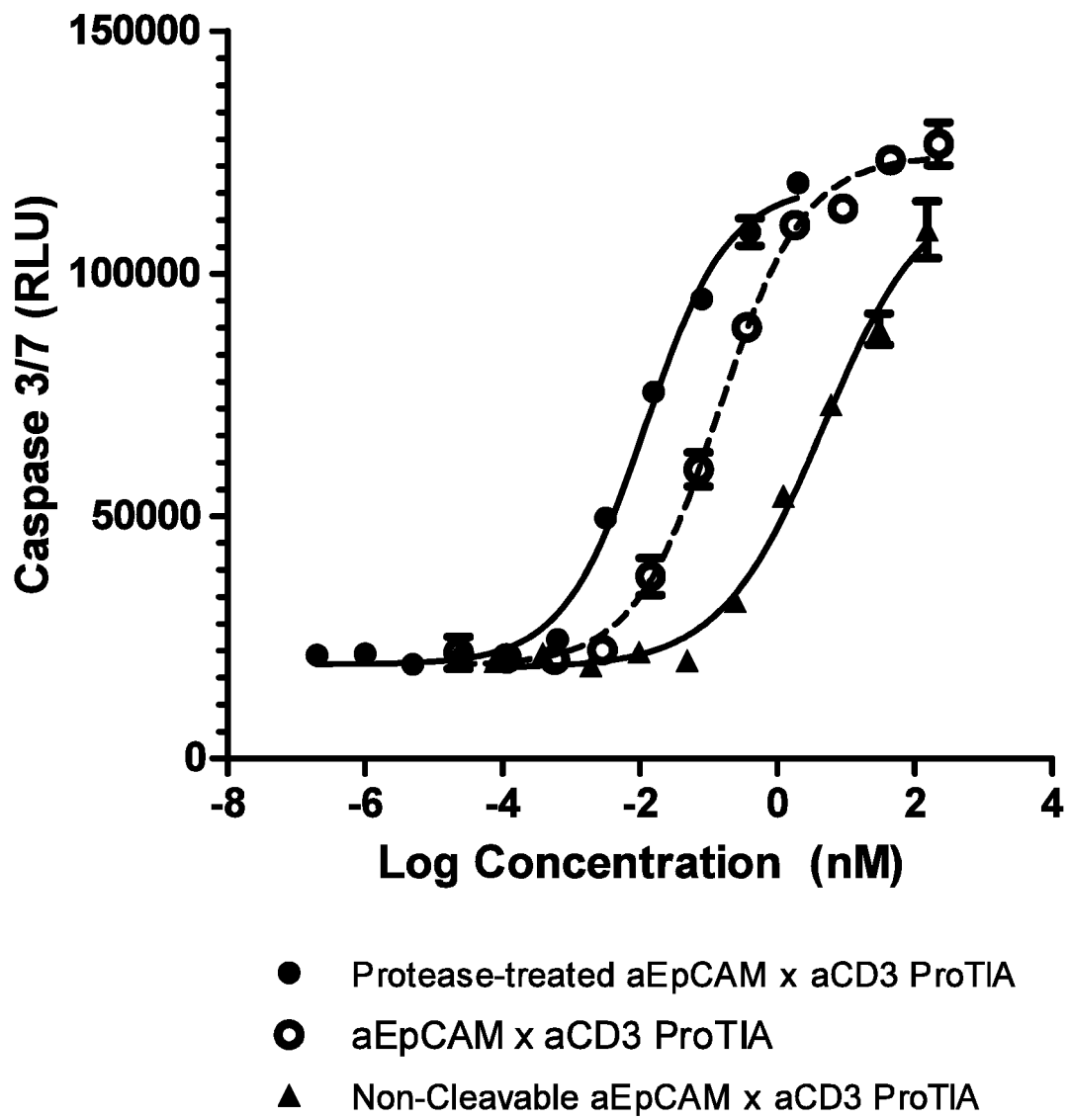
FIG. 57 depicts results from the experiment to determine the in vitro activity of protease-treated, protease-untreated and protease-noncleavable antiEpCAM×antiCD3 ProTIA in SKOV3 with human PBMC as described in Example 23.
Figure 58:
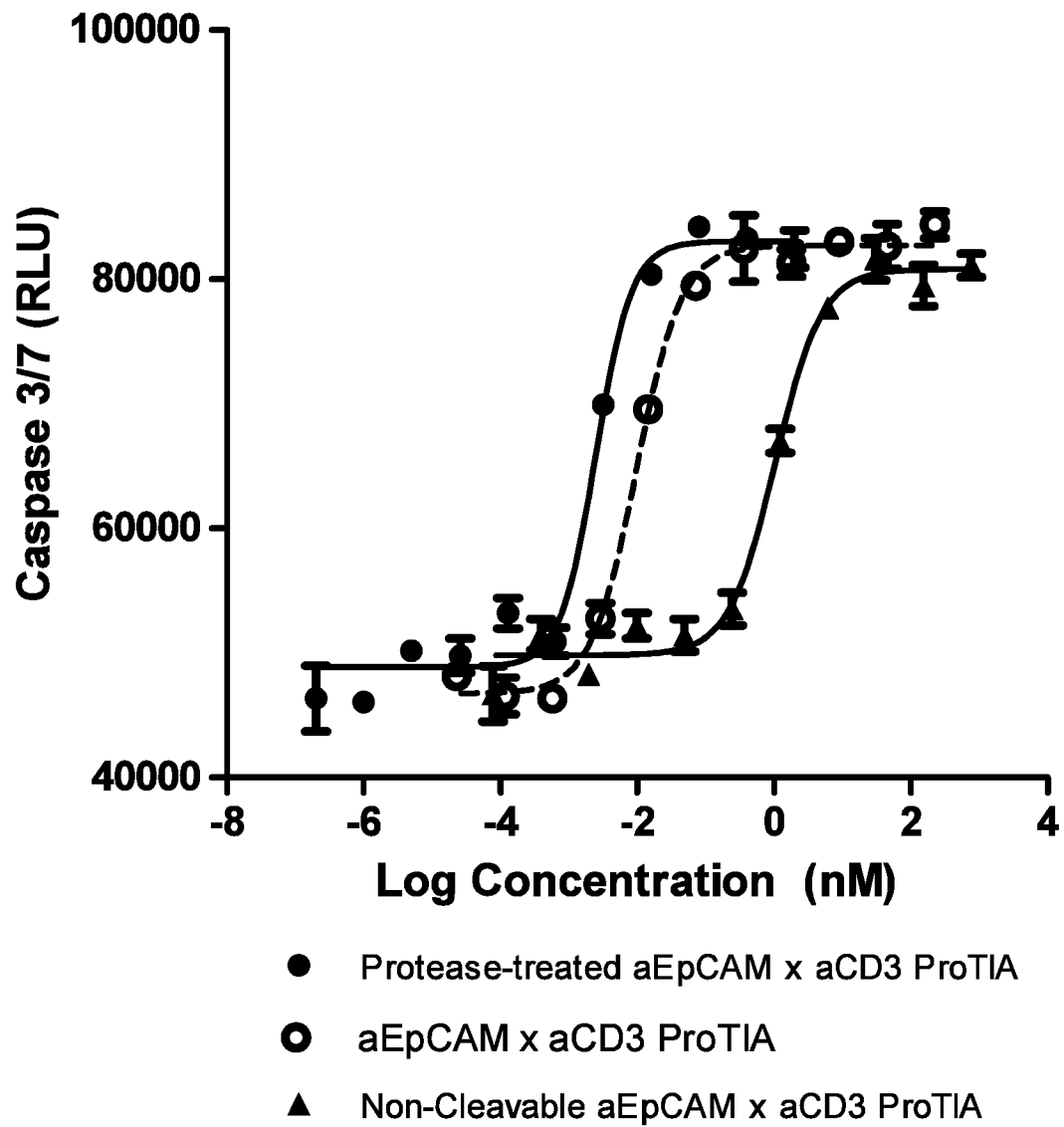
FIG. 58 depicts results from the experiment to determine the in vitro activity of protease-treated, protease-untreated and protease-noncleavable antiEpCAM×antiCD3 ProTIA in OVCAR3 with human PBMC as described in Example 23.
Figure 59:
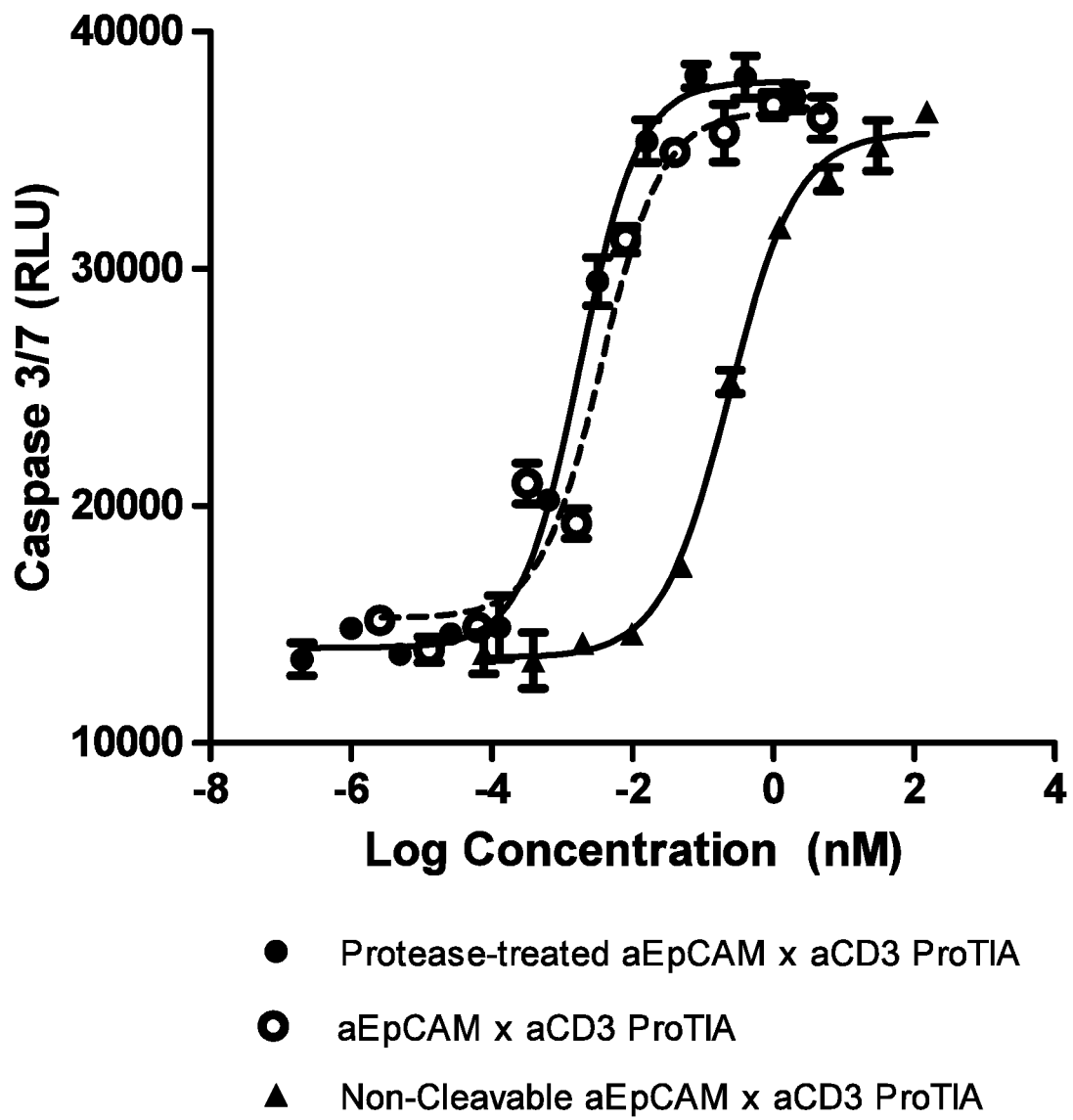
FIG. 59 depicts results from the experiment to determine the in vitro activity of protease-treated, protease-untreated and protease-noncleavable antiEpCAM×antiCD3 ProTIA in HCT116 with human PBMC as described in Example 23.
Figure 60:
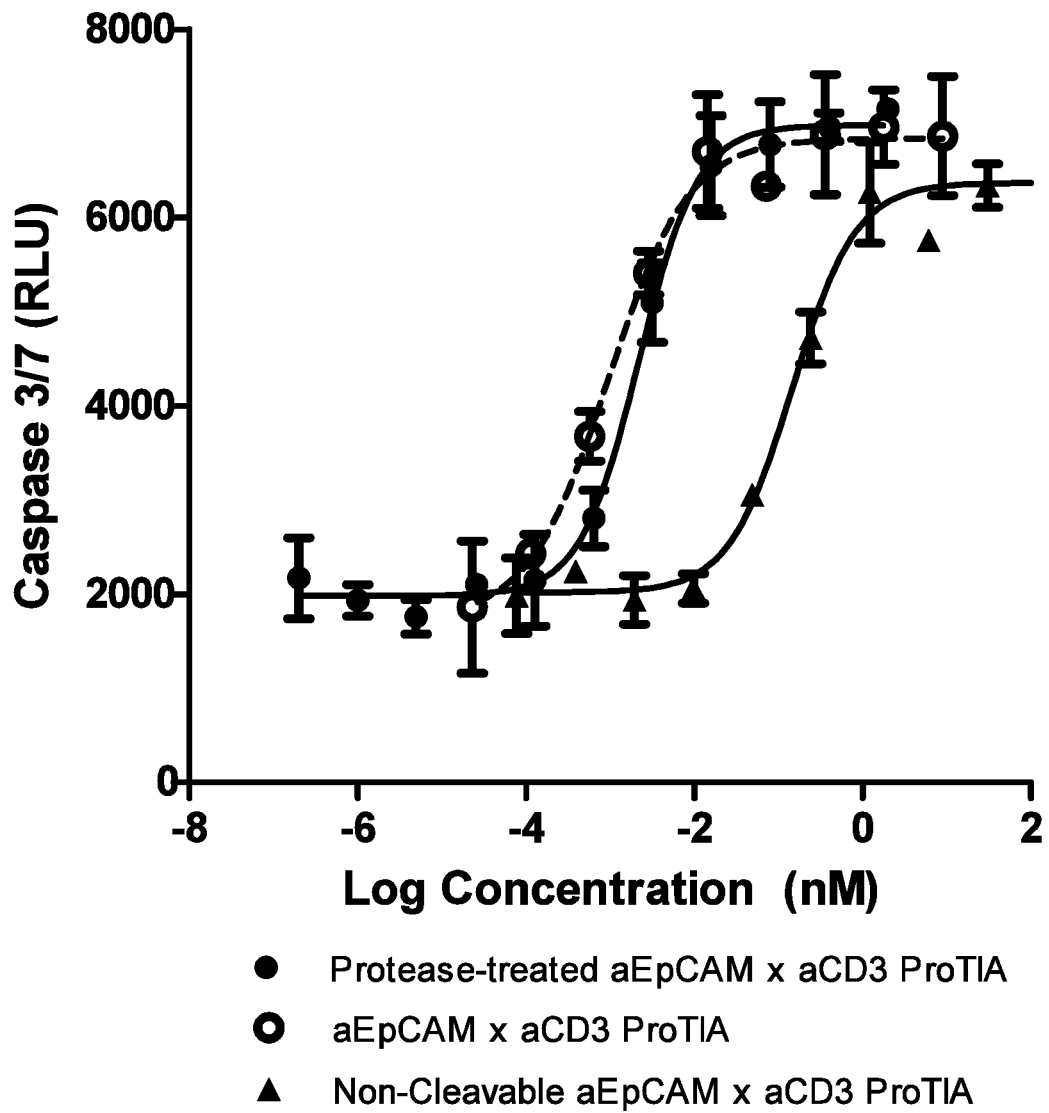
FIG. 60 depicts results from the experiment to determine the in vitro activity of protease-treated, protease-untreated and protease-noncleavable antiEpCAM×antiCD3 ProTIA in SW480 with human PBMC as described in Example 23.

As expected, the activity trend of the protease-treated, protease-untreated and non-cleavable anti-EpCAM×anti-CD3 ProTIA profiled in SK-OV-3, OVCAR-3, HCT-116 and SW480 tumor cell lines was found to be in agreement with the activities observed in the LDH assay analysis. In the cytotoxic killing of SK-OV-3 ovarian cells by human PBMC, untreated anti-EpCAM×anti-CD3 ProTIA is 12-fold less active than protease-treated ProTIA ($EC_{50}$ of 140 pM vs. 12 pM); and the non-cleavable anti-EpCAM×anti-CD3 ProTIA is 390-fold less active than the protease-cleaved ProTIA ($EC_{50}$ of 4700 pM vs. 12 pM) (FIG. 57). In the cytotoxic killing of OVCAR-3 ovarian cells by PBMC, protease-uncleaved anti-EpCAM×anti-CD3 ProTIA is 4-fold less active than protease-treated ProTIA ($EC_{50}$ of 9.8 pM vs. 2.5 pM); and the non-cleavable anti-EpCAM×anti-CD3 ProTIA is 420-fold less active than the protease-cleaved ProTIA ($EC_{50}$ of 1043 pM vs. 2.5 pM) (FIG. 58). In the cytotoxic killing of HCT-116 colorectal cells by PBMC, protease-treated and intact protease-untreated anti-EpCAM×anti-CD3 ProTIA have almost similar activity ($EC_{50}$ of 1.8 pM vs. 3.6 pM); and the non-cleavable anti-EpCAM×anti-CD3 ProTIA is 130-fold less active than the protease-cleaved ProTIA ($EC_{50}$ of 240 pM vs. 1.8 pM) (FIG. 59). In the cytotoxic killing of SW480 colorectal cells by PBMC, protease-treated and protease-uncleaved anti-EpCAM×anti-CD3 ProTIA also demonstrated similar activity ($EC_{50}$ of 2 pM vs. 1 pM); and the non-cleavable anti-EpCAM×anti-CD3 ProTIA is 70-fold less active than the protease-cleaved ProTIA ($EC_{50}$ of 148 pM vs. 2 pM) (FIG. 60). Results demonstrated that non-cleavable ProTIA is consistently less active than the unXTENylated anti-EpCAM×anti-CD3 moiety. Depending on cell lines used, the activity of intact, protease-untreated ProTIA ranged from similar to 12-fold less active as compared to protease-cleaved ProTIA, suggesting a difference in degree of susceptibility of the release segment to proteases postulated to be released from the tumor cells and/or activated CD3 positive T cells in the assay mixture.

Example 24: Proteolytic Cleavage of AC1476 aEpCAM-aCD3-BSRS1-XTEN_AE864-His(6) Using Various Proteases ("His(6)" Disclosed as SEQ ID NO: 483)

The experiment was conducted to demonstrate that the aEpCAM-aCD3-BSRS1-XTEN_AE864-His(6) AC1476 ("His(6)" disclosed as SEQ ID NO: 483), previously described in Example 3, can be cleaved in vitro by multiple tumor-associated proteases, including MMP-2, MMP-9, and neutrophil elastase.

1. Enzyme Activation

All enzymes used were obtained from R&D Systems. Recombinant neutrophil elastase and recombinant human matriptase were provided as activated enzymes and stored at −80° C. until use. Recombinant mouse MMP-2 and recombinant mouse MMP-9 were supplied as zymogens and required activation by 4-aminophenylmercuric acetate (APMA). APMA was first dissolved in 0.1M NaOH to a final concentration of 10 mM before the pH was readjusted to neutral using 0.1N HCl. Further dilution of the APMA stock to 2.5 mM was done in 50 mM Tris, 150 mM NaCl, 10 mM CaCl2, pH 7.5. To activate pro-MMP, 1 mM APMA and 100 μg/mL of pro-MMP were incubated at 37° C. for 1 hour (MMP-2) or 3 hours (MMP-9). Glycerol was added to activated enzymes to a final concentration of 50% and then each was stored at −20° C.

2. Enzymatic Digestion

A panel of enzymes was used to digest the AC1476 aEpCAM-aCD3-BSRS1-XTEN_AE864-His(6) ProTIA ("His(6)" disclosed as SEQ ID NO: 483) composition. 10 μM of the substrate composition was incubated individually with each enzyme in the following enzyme-to-substrate molar ratios: MMP-2 (1:200), MMP-9 (1:2000), matriptase (1:12.5), and neutrophil elastase (1:1000). Reactions were incubated at 37° C. for two hours before stopping digestion by gel loading dye and heating at 80° C.

3. Analysis of Cleavage.

Analysis of the samples was performed by loading 5 μg of undigested and digested material on SDS-PAGE and staining with Coomassie Blue. Upon treatment by each protease at the BSRS-1 release segment, the substrate yielded two fragments detectable in the SDS-PAGE gel, with the small fragment containing aEpCAM-aCD3 (the activated first portion form with the binding domains) and the other containing released XTEN bulking moiety, which migrates at a slightly lower apparent molecular weight on SDS-PAGE than the intact form. For neutrophil elastase, which also digests released XTEN, the activated form was observed in the gel as well as other smaller fragments; the latter due to the cleavage of XTEN at various locations along the sequence. The results confirm that all proteases tested cleaved the construct as intended, with the release of the binding domains.

TABLE 12

Chimeric Polypeptide Assembly Sequences

| Construct ID | Tumor Targets | Amino Acid Sequences | SEQ ID NO: |
|---|---|---|---|
| AC1277 | CD19 | HHHHHHHHDIQLTQSPASLAVSLGQRATISCKASQSVDYDGDSYLN WYQQIPGQPPKLLIYDASNLVSGIPPRFSGSGSGTDFTLNIHPVEK VDAATYHCQQSTEDPWTFGGGTKLEIKGGGGSGGGGSGGGGSQVQL QQSGAELVRPGSSVKISCKASGYAFSSYWMNWVKQRPGQGLEWIGQ IWPGDGDTNYNGKFKGKATLTADESSSTAYMQLSSLASEDSAVYFC ARRETTTVGRYYYAMDYWGQGTTVTVSSGGGGSDIKLQQSGAELAR PGASVKMSCKTSGYTFTRYTMHWVKQRPGQGLEWIGYINPSRGYTN YNQKFKDKATLTTDKSSSTAYMQLSSLTSEDSAVYYCARYYDDHYC LDYWGQGTTLTVSSVEGGSGGSGGSGGSGGVDDIQLTQSPAIMSAS PGEKVTMTCRASSSVSYMNWYQQKSGTSPKRWIYDTSKVASGVPYR FSGSGSGTSYSLTISSMEAEDAATYYCQQWSSNPLTFGAGTKLELK GTAEAASASGLSGRSDNHSPLGLAGSPGSPAGSPTSTEEGTSESAT PESGPGTSTEPSEGSAPGSPAGSPTSTEEGTSTEPSEGSAPGTSTE PSEGSAPGTSESATPESGPGSEPATSGSETPGSEPATSGSETPGSP AGSPTSTEEGTSESATPESGPGTSTEPSEGSAPGTSTEPSEGSAPG SPAGSPTSTEEGTSTEPSEGSAPGTSTEPSEGSAPGTSESATPESG PGTSTEPSEGSAPGTSESATPESGPGSEPATSGSETPGTSTEPSEG SAPGTSTEPSEGSAPGTSESATPESGPGTSESATPESGPGSPAGSP TSTEEGTSESATPESGPGSEPATSGSETPGTSESATPESGPGTSTE PSEGSAPGTSTEPSEGSAPGTSTEPSEGSAPGTSTEPSEGSAPGTS TEPSEGSAPGTSTEPSEGSAPGSPAGSPTSTEEGTSTEPSEGSAPG TSESATPESGPGSEPATSGSETPGTSESATPESGPGSEPATSGSET PGTSESATPESGPGTSTEPSEGSAPGTSESATPESGPGSPAGSPTS TEEGSPAGSPTSTEEGSPAGSPTSTEEGTSESATPESGPGTSTEPS EGSAPGTSESATPESGPGSEPATSGSETPGTSESATPESGPGSEPA TSGSETPGTSESATPESGPGTSTEPSEGSAPGSPAGSPTSTEEGTS ESATPESGPGSEPATSGSETPGTSESATPESGPGSPAGSPTSTEEG SPAGSPTSTEEGTSTEPSEGSAPGTSESATPESGPGTSESATPESG PGTSESATPESGPGSEPATSGSETPGSEPATSGSETPGSPAGSPTS TEEGTSTEPSEGSAPGTSTEPSEGSAPGSEPATSGSETPGTSESAT PESGPGTSTEPSEGSAPG | 485 |
| AC1278 | EpCAM | HHHHHHHHELVMTQSPSSLTVTAGEKVTMSCKSSQSLLNSGNQKNY LTWYQQKPGQPPKLLIYWASTRESGVPDRFTGSGSGTDFTLTISSV QAEDLAVYYCQNDYSYPLTFGAGTKLEIKGGGGSGGGGSGGGGSEV QLLEQSGAELVRPGTSVKISCKASGYAFTNYWLGWVKQRPGHGLEW IGDIFPGSGNIHYNEKFKGKATLTADKSSSTAYMQLSSLTFEDSAV | 486 |

TABLE 12-continued

Chimeric Polypeptide Assembly Sequences

| Construct ID | Tumor Targets | Amino Acid Sequences | SEQ ID NO: |
|---|---|---|---|
| | | YFCARLRNWDEPMDYWGQGTTVTVSSGGGGSDVQLVQSGAEVKKPG ASVKVSCKASGYTFTRYTMHWVRQAPGQGLEWIGYINPSRGYTNYA DSVKGRFTITTDKSTSTAYMELSSLRSEDTATYYCARYYDDHYCLD YWGQGTTVTVSSGEGTSTGSGGSGGSGGADDIVLTQSPATLSLSPG ERATLSCRASQSVSYMNWYQQKPGKAPKRWIYDTSKVASGVPARFS GSGSGTDYSLTINSLEAEDAATYYCQQWSSNPLTFGGGTKVEIKGT AEAASASGLSGRSDNHSPLGLAGSPGSPAGSPTSTEEGTSESATPE SGPGTSTEPSEGSAPGSPAGSPTSTEEGTSTEPSEGSAPGTSTEPS EGSAPGTSESATPESGPGSEPATSGSETPGSEPATSGSETPGSPAG SPTSTEEGTSESATPESGPGTSTEPSEGSAPGTSTEPSEGSAPGSP AGSPTSTEEGTSTEPSEGSAPGTSTEPSEGSAPGTSESATPESGPG TSTEPSEGSAPGTSESATPESGPGSEPATSGSETPGTSTEPSEGSA PGTSTEPSEGSAPGTSESATPESGPGTSESATPESGPGSPAGSPTS TEEGTSESATPESGPGSEPATSGSETPGTSESATPESGPGTSTEPS EGSAPGTSTEPSEGSAPGTSTEPSEGSAPGTSTEPSEGSAPGTSTE PSEGSAPGTSTEPSEGSAPGSPAGSPTSTEEGTSTEPSEGSAPGTS ESATPESGPGSEPATSGSETPGTSESATPESGPGSEPATSGSETPG TSESATPESGPGTSTEPSEGSAPGTSESATPESGPGSPAGSPTSTE EGSPAGSPTSTEEGSPAGSPTSTEEGTSESATPESGPGTSTEPSEG SAPGTSESATPESGPGSEPATSGSETPGTSESATPESGPGSEPATS GSETPGTSESATPESGPGTSTEPSEGSAPGSPAGSPTSTEEGTSES ATPESGPGSEPATSGSETPGTSESATPESGPGSPAGSPTSTEEGSP AGSPTSTEEGTSTEPSEGSAPGTSESATPESGPGTSESATPESGPG TSESATPESGPGSEPATSGSETPGSEPATSGSETPGSPAGSPTSTE EGTSTEPSEGSAPGTSTEPSEGSAPGSEPATSGSETPGTSESATPE SGPGTSTEPSEGSAPG | |
| AC1345 | EpCAM | HHHHHHHHEVQLLEQSGAELVRPGTSVKISCKASGYAFTNYWLGWV KQRPGHGLEWIGDIFPGSGNIHYNEKFKGKATLTADKSSSTAYMQL SSLTFEDSAVYFCARLRNWDEPMDYWGQGTTVTVSSGGGGSDVQLV QSGAEVKKPGASVKVSCKASGYTFTRYTMHWVRQAPGQGLEWIGYI NPSRGYTNYADSVKGRFTITTDKSTSTAYMELSSLRSEDTATYYCA RYYDDHYCLDYWGQGTTVTVSSGEGTSTGSGGSGGSGGADDIVLTQ SPATLSLSPGERATLSCRASQSVSYMNWYQQKPGKAPKRWIYDTSK VASGVPARFSGSGSGTDYSLTINSLEAEDAATYYCQQWSSNPLTFG GGTKVEIKGGGGSELVMTQSPSSLTVTAGEKVTMSCKSSQSLLNSG NQKNYLTWYQQKPGQPPKLLIYWASTRESGVPDRFTGSGSGTDFTL TISSVQAEDLAVYYCQNDYSYPLTFGAGTKLEIKGTAEAASASGLS GRSDNHSPLGLAGSPGSPAGSPTSTEEGTSESATPESGPGTSTEPS EGSAPGSPAGSPTSTEEGTSTEPSEGSAPGTSTEPSEGSAPGTSES ATPESGPGSEPATSGSETPGSEPATSGSETPGSPAGSPTSTEEGTS ESATPESGPGTSTEPSEGSAPGTSTEPSEGSAPGSPAGSPTSTEEG TSTEPSEGSAPGTSTEPSEGSAPGTSESATPESGPGTSTEPSEGSA PGTSESATPESGPGSEPATSGSETPGTSTEPSEGSAPGTSTEPSEG SAPGTSESATPESGPGTSESATPESGPGSPAGSPTSTEEGTSESAT PESGPGSEPATSGSETPGTSESATPESGPGTSTEPSEGSAPGTSTE PSEGSAPGTSTEPSEGSAPGTSTEPSEGSAPGTSTEPSEGSAPGTS TEPSEGSAPGSPAGSPTSTEEGTSTEPSEGSAPGTSESATPESGPG SEPATSGSETPGTSESATPESGPGSEPATSGSETPGTSESATPESG PGTSTEPSEGSAPGTSESATPESGPGSPAGSPTSTEEGSPAGSPTS TEEGSPAGSPTSTEEGTSESATPESGPGTSTEPSEGSAPGTSESAT PESGPGSEPATSGSETPGTSESATPESGPGSEPATSGSETPGTSES ATPESGPGTSTEPSEGSAPGSPAGSPTSTEEGTSESATPESGPGSE PATSGSETPGTSESATPESGPGSPAGSPTSTEEGSPAGSPTSTEEG TSTEPSEGSAPGTSESATPESGPGTSESATPESGPGTSESATPESG PGSEPATSGSETPGSEPATSGSETPGSPAGSPTSTEEGTSTEPSEG SAPGTSTEPSEGSAPGSEPATSGSETPGTSESATPESGPGTSTEPS EGSAPG | 487 |
| AC1346 | EpCAM | HHHHHHHHDVQLVQSGAEVKKPGASVKVSCKASGYTFTRYTMHWVR QAPGQGLEWIGYINPSRGYTNYADSVKGRFTITTDKSTSTAYMELS SLRSEDTATYYCARYYDDHYCLDYWGQGTTVTVSSGGSELVMTQSP SSLTVTAGEKVTMSCKSSQSLLNSGNQKNYLTWYQQKPGQPPKLLI YWASTRESGVPDRFTGSGSGTDFTLTISSVQAEDLAVYYCQNDYSY PLTFGAGTKLEIKGGGGSGGGGSGGGGSEVQLLEQSGAELVRPGTS VKISCKASGYAFTNYWLGWVKQRPGHGLEWIGDIFPGSGNIHYNEK FKGKATLTADKSSSTAYMQLSSLTFEDSAVYFCARLRNWDEPMDYW GQGTTVTVSSGGGSDIVLTQSPATLSLSPGERATLSCRASQSVSYM NWYQQKPGKAPKRWIYDTSKVASGVPARFSGSGSGTDYSLTINSLE AEDAATYYCQQWSSNPLTFGGGTKVEIKGTAEAASASGLSGRSDNH SPLGLAGSPGSPAGSPTSTEEGTSESATPESGPGTSTEPSEGSAPG SPAGSPTSTEEGTSTEPSEGSAPGTSTEPSEGSAPGTSESATPESG PGSEPATSGSETPGSEPATSGSETPGSPAGSPTSTEEGTSESATPE SGPGTSTEPSEGSAPGTSTEPSEGSAPGSPAGSPTSTEEGTSTEPS | 488 |

TABLE 12-continued

Chimeric Polypeptide Assembly Sequences

| Construct ID | Tumor Targets | Amino Acid Sequences | SEQ ID NO: |
|---|---|---|---|
| | | EGSAPGTSTEPSEGSAPGTSESATPESGPGTSTEPSEGSAPGTSES ATPESGPGSEPATSGSETPGTSTEPSEGSAPGTSTEPSEGSAPGTS ESATPESGPGTSESATPESGPGSPAGSPTSTEEGTSESATPESGPG SEPATSGSETPGTSESATPESGPGTSTEPSEGSAPGTSTEPSEGSA PGTSTEPSEGSAPGTSTEPSEGSAPGTSTEPSEGSAPGTSTEPSEG SAPGSPAGSPTSTEEGTSTEPSEGSAPGTSESATPESGPGSEPATS GSETPGTSESATPESGPGSEPATSGSETPGTSESATPESGPGTSTE PSEGSAPGTSESATPESGPGSPAGSPTSTEEGSPAGSPTSTEEGSP AGSPTSTEEGTSESATPESGPGTSTEPSEGSAPGTSESATPESGPG SEPATSGSETPGTSESATPESGPGSEPATSGSETPGTSESATPESG PGTSTEPSEGSAPGSPAGSPTSTEEGTSESATPESGPGSEPATSGS ETPGTSESATPESGPGSPAGSPTSTEEGSPAGSPTSTEEGTSTEPS EGSAPGTSESATPESGPGTSESATPESGPGTSESATPESGPGSEPA TSGSETPGSEPATSGSETPGSPAGSPTSTEEGTSTEPSEGSAPGTS TEPSEGSAPGSEPATSGSETPGTSESATPESGPGTSTEPSEGSAPG | |
| AC1357 | EpCAM | HHHHHHHHELVMTQSPSSLTVTAGEKVTMSCKSSQSLLNSGNQKNY LTWYQQKPGQPPKLLIYWASTRESGVPDRFTGSGSGTDFTLTISSV QAEDLAVYYCQNDYSYPLTFGAGTKLEIKGGGGSGGGGSGGGGSEV QLLEQSGAELVRPGTSVKISCKASGYAFTNYWLGWVKQRPGHGLEW IGDIFPGSGNIHYNEKFKGKATLTADKSSSTAYMQLSSLTFEDSAV YFCARLRNWDEPMDYWGQGTTVTVSSGGGGSDVQLVQSGAEVKKPG ASVKVSCKASGYTFTRYTMHWVRQAPGQGLEWIGYINPSRGYTNYA DSVKGRFTITTDKSTSTAYMELSSLRSEDTATYYCARYYDDHYCLD YWGQGTTVTVSSGEGTSTGSGGSGGSGGADDIVLTQSPATLSLSPG ERATLSCRASQSVSYMNWYQQKPGKAPKRWIYDTSKVASGVPARFS GSGSGTDYSLTINSLEAEDAATYYCQQWSSNPLTFGGGTKVEIKGS PGSPAGSPTSTEEGTSESATPESGPGTSTEPSEGSAPGSPAGSPTS TEEGTSTEPSEGSAPGTSTEPSEGSAPGTSESATPESGPGSEPATS GSETPGSEPATSGSETPGSPAGSPTSTEEGTSESATPESGPGTSTE PSEGSAPGTSTEPSEGSAPGSPAGSPTSTEEGTSTEPSEGSAPGTS TEPSEGSAPGTSESATPESGPGTSTEPSEGSAPGTSESATPESGPG SEPATSGSETPGTSTEPSEGSAPGTSTEPSEGSAPGTSESATPESG PGTSESATPESGPGSPAGSPTSTEEGTSESATPESGPGSEPATSGS ETPGTSESATPESGPGTSTEPSEGSAPGTSTEPSEGSAPGTSTEPS EGSAPGTSTEPSEGSAPGTSTEPSEGSAPGTSTEPSEGSAPGSPAG SPTSTEEGTSTEPSEGSAPGTSESATPESGPGSEPATSGSETPGTS ESATPESGPGSEPATSGSETPGTSESATPESGPGTSTEPSEGSAPG TSESATPESGPGSPAGSPTSTEEGSPAGSPTSTEEGSPAGSPTSTE EGTSESATPESGPGTSTEPSEGSAPGTSESATPESGPGSEPATSGS ETPGTSESATPESGPGSEPATSGSETPGTSESATPESGPGTSTEPS EGSAPGSPAGSPTSTEEGTSESATPESGPGSEPATSGSETPGTSES ATPESGPGSPAGSPTSTEEGSPAGSPTSTEEGTSTEPSEGSAPGTS ESATPESGPGTSESATPESGPGTSESATPESGPGSEPATSGSETPG SEPATSGSETPGSPAGSPTSTEEGTSTEPSEGSAPGTSTEPSEGSA PGSEPATSGSETPGTSESATPESGPGTSTEPSEGSAPG | 489 |
| AC1358 | EpCAM | HHHHHHHHELVMTQSPSSLTVTAGEKVTMSCKSSQSLLNSGNQKNY LTWYQQKPGQPPKLLIYWASTRESGVPDRFTGSGSGTDFTLTISSV QAEDLAVYYCQNDYSYPLTFGAGTKLEIKGGGGSGGGGSGGGGSEV QLLEQSGAELVRPGTSVKISCKASGYAFTNYWLGWVKQRPGHGLEW IGDIFPGSGNIHYNEKFKGKATLTADKSSSTAYMQLSSLTFEDSAV YFCARLRNWDEPMDYWGQGTTVTVSSGGGGSDIQMTQSPSSLSASV GDRVTITCRASQDIRNYLNWYQQKPGKAPKLLIYYTSRLESGVPSR FSGSGSGTDYTLTISSLQPEDFATYYCQQGNTLPWTFGQGTKVEIK RTSGPGDGGKGGPGKGPGGEGTKGTGPGGEVQLVESGGGLVQPGGS LRLSCAASGYSFTGYTMNWVRQAPGKGLEWVALINPYKGVSTYNQK FKDRFTISVDKSKNTAYLQMNSLRAEDTAVYYCARSGYYGDSDWYF DVWGQGTLVTVSSGTAEAASASGLSGRSDNHSPLGLAGSPGSPAGS PTSTEEGTSESATPESGPGTSTEPSEGSAPGSPAGSPTSTEEGTST EPSEGSAPGTSTEPSEGSAPGTSESATPESGPGSEPATSGSETPGS EPATSGSETPGSPAGSPTSTEEGTSESATPESGPGTSTEPSEGSAP GTSTEPSEGSAPGSPAGSPTSTEEGTSTEPSEGSAPGTSTEPSEGS APGTSESATPESGPGTSTEPSEGSAPGTSESATPESGPGSEPATSG SETPGTSTEPSEGSAPGTSTEPSEGSAPGTSESATPESGPGTSESA TPESGPGSPAGSPTSTEEGTSESATPESGPGSEPATSGSETPGTSE SATPESGPGTSTEPSEGSAPGTSTEPSEGSAPGTSTEPSEGSAPGT STEPSEGSAPGTSTEPSEGSAPGTSTEPSEGSAPGSPAGSPTSTEE GTSTEPSEGSAPGTSESATPESGPGSEPATSGSETPGTSESATPES GPGSEPATSGSETPGTSESATPESGPGTSTEPSEGSAPGTSESATP ESGPGSPAGSPTSTEEGSPAGSPTSTEEGSPAGSPTSTEEGTSESA TPESGPGTSTEPSEGSAPGTSESATPESGPGSEPATSGSETPGTSE SATPESGPGSEPATSGSETPGTSESATPESGPGTSTEPSEGSAPGS PAGSPTSTEEGTSESATPESGPGSEPATSGSETPGTSESATPESGP | 490 |

TABLE 12-continued

Chimeric Polypeptide Assembly Sequences

| Construct ID | Tumor Targets | Amino Acid Sequences | SEQ ID NO: |
|---|---|---|---|
| | | GSPAGSPTSTEEGSPAGSPTSTEEGTSTEPSEGSAPGTSESATPES GPGTSESATPESGPGTSESATPESGPGSEPATSGSETPGSEPATSG SETPGSPAGSPTSTEEGTSTEPSEGSAPGTSTEPSEGSAPGSEPAT SGSETPGTSESATPESGPGTSTEPSEGSAPG | |
| AC1359 | EpCAM | HHHHHHHHELVMTQSPSSLTVTAGEKVTMSCKSSQSLLNSGNQKNY LTWYQQKPGQPPKLLIYWASTRESGVPDRFTGSGSGTDFTLTISSV QAEDLAVYYCQNDYSYPLTFGAGTKLEIKGGGGSGGGGSGGGGSEV QLLEQSGAELVRPGTSVKISCKASGYAFTNYWLGWVKQRPGHGLEW IGDIFPGSGNIHYNEKFKGKATLTADKSSSTAYMQLSSLTFEDSAV YFCARLRNWDEPMDYWGQGTTVTVSSGGGGSEVQLVESGGGLVQPG GSLRLSCAASGYSFTGYTMNWVRQAPGKGLEWVALINPYKGVSTYN QKFKDRFTISVDKSKNTAYLQMNSLRAEDTAVYYCARSGYYGDSDW YFDVWGQGTLVTVSSRTSGPGDGGKGGPGKGPGGEGTKGTGPGGDI QMTQSPSSLSASVGDRVTITCRASQDIRNYLNWYQQKPGKAPKLLI YYTSRLESGVPSRFSGSGSGTDYTLTISSLQPEDFATYYCQQGNTL PWTFGQGTKVEIKGTAEAASASGLSGRSDNHSPLGLAGSPGSPAGS PTSTEEGTSESATPESGPGTSTEPSEGSAPGSPAGSPTSTEEGTST EPSEGSAPGTSTEPSEGSAPGTSESATPESGPGSEPATSGSETPGS EPATSGSETPGSPAGSPTSTEEGTSESATPESGPGTSTEPSEGSAP GTSTEPSEGSAPGSPAGSPTSTEEGTSTEPSEGSAPGTSTEPSEGS APGTSESATPESGPGTSTEPSEGSAPGTSESATPESGPGSEPATSG SETPGTSTEPSEGSAPGTSTEPSEGSAPGTSESATPESGPGTSESA TPESGPGSPAGSPTSTEEGTSESATPESGPGSEPATSGSETPGTSE SATPESGPGTSTEPSEGSAPGTSTEPSEGSAPGTSTEPSEGSAPGT STEPSEGSAPGTSTEPSEGSAPGTSTEPSEGSAPGSPAGSPTSTEE GTSTEPSEGSAPGTSESATPESGPGSEPATSGSETPGTSESATPES GPGSEPATSGSETPGTSESATPESGPGTSTEPSEGSAPGTSESATP ESGPGSPAGSPTSTEEGSPAGSPTSTEEGSPAGSPTSTEEGTSESA TPESGPGTSTEPSEGSAPGTSESATPESGPGSEPATSGSETPGTSE SATPESGPGSEPATSGSETPGTSESATPESGPGTSTEPSEGSAPGS PAGSPTSTEEGTSESATPESGPGSEPATSGSETPGTSESATPESGP GSPAGSPTSTEEGSPAGSPTSTEEGTSTEPSEGSAPGTSESATPES GPGTSESATPESGPGTSESATPESGPGSEPATSGSETPGSEPATSG SETPGSPAGSPTSTEEGTSTEPSEGSAPGTSTEPSEGSAPGSEPAT SGSETPGTSESATPESGPGTSTEPSEGSAPG | 491 |
| AC1409 | EpCAM | HHHHHHHHGTSESATPESGPGSEPATSGSETPGTSESATPESGPGS EPATSGSETPGTSESATPESGPGTSTEPSEGSAPGSPAGSPTSTEE GTSESATPESGPGSEPATSGSETPGTSESATPESGPGSPAGSPTST EEGSPAGSPTSTEEGTSTEPSEGSAPGTSESATPESGPGTSESATP ESGPGTSESATPESGPGSEPATSGSETPGSEPATSGSETPGSPAGS PTSTEEGTSTEPSEGSAPGTSTEPSEGSAPGSEPATSGSETPGTSE SATPESGPGTSTEPSEGSAPGLSGRSDNHSPLGLAGSGTAEAASAS GELVMTQSPSSLTVTAGEKVTMSCKSSQSLLNSGNQKNYLTWYQQK PGQPPKLLIYWASTRESGVPDRFTGSGSGTDFTLTISSVQAEDLAV YYCQNDYSYPLTFGAGTKLEIKGGGGSGGGGSGGGGSEVQLLEQSG AELVRPGTSVKISCKASGYAFTNYWLGWVKQRPGHGLEWIGDIFPG SGNIHYNEKFKGKATLTADKSSSTAYMQLSSLTFEDSAVYFCARLR NWDEPMDYWGQGTTVTVSSGGGGSDVQLVQSGAEVKKPGASVKVSC KASGYTFTRYTMHWVRQAPGQGLEWIGYINPSRGYTNYADSVKGRF TITTDKSTSTAYMELSSLRSEDTATYYCARYYDDHYCLDYWGQGTT VTVSSGEGTSTGSGGSGGSGADDIVLTQSPATLSLSPGERATLSC RASQSVSYMNWYQQKPGKAPKRWIYDTSKVASGVPARFSGSGSGTD YSLTINSLEAEDAATYYCQQWSSNPLTFGGGTKVEIKGTAEAASAS GLSGRSDNHSPLGLAGSPGSPAGSPTSTEEGTSESATPESGPGTST EPSEGSAPGSPAGSPTSTEEGTSTEPSEGSAPGTSTEPSEGSAPGT SESATPESGPGSEPATSGSETPGSEPATSGSETPGSPAGSPTSTEE GTSESATPESGPGTSTEPSEGSAPGTSTEPSEGSAPGSPAGSPTST EEGTSTEPSEGSAPGTSTEPSEGSAPGTSESATPESGPGTSTEPSE GSAPGTSESATPESGPGSEPATSGSETPGTSTEPSEGSAPGTSTEP SEGSAPGTSESATPESGPGTSESATPESGPGSPAGSPTSTEEGTSE SATPESGPGSEPATSGSETPGTSESATPESGPGTSTEPSEGSAPGT STEPSEGSAPGTSTEPSEGSAPGTSTEPSEGSAPGTSTEPSEGSAP GTSTEPSEGSAPGSPAGSPTSTEEGTSTEPSEGSAPGTSESATPES GPGSEPATSGSETPGTSESATPESGPGSEPATSGSETPGTSESATP ESGPGTSTEPSEGSAPGTSESATPESGPGSPAGSPTSTEEGSPAGS PTSTEEGSPAGSPTSTEEGTSESATPESGPGTSTEPSEGSAPG | 492 |
| AC1410 | EpCAM | GSPGSPAGSPTSTEEGTSESATPESGPGTSTEPSEGSAPGSPAGSP TSTEEGTSTEPSEGSAPGTSTEPSEGSAPGTSESATPESGPGSEPA TSGSETPGSEPATSGSETPGSPAGSPTSTEEGTSESATPESGPGTS TEPSEGSAPGTSTEPSEGSAPGSPAGSPTSTEEGTSTEPSEGSAPG TSTEPSEGSAPGTSESATPESGPGTSTEPSEGSAPGTSESATPESG | 493 |

TABLE 12-continued

Chimeric Polypeptide Assembly Sequences

| Construct ID | Tumor Targets | Amino Acid Sequences | SEQ ID NO: |
|---|---|---|---|
| | | PGSEPATSGSETPGTSTEPSEGSAPGTSTEPSEGSAPGTSESATPE SGPGTSESATPESGPGSPAGSPTSTEEGTSESATPESGPGSEPATS GSETPGTSESATPESGPGTSTEPSEGSAPGTSTEPSEGSAPGTSTE PSEGSAPGTSTEPSEGSAPGTSTEPSEGSAPGTSTEPSEGSAPGSP AGSPTSTEEGTSTEPSEGSAPGTSESATPESGPGSEPATSGSETPG TSESATPESGPGSEPATSGSETPGTSESATPESGPGTSTEPSEGSA PGTSESATPESGPGSPAGSPTSTEEGSPAGSPTSTEEGSPAGSPTS TEEGTSESATPESGPGTSTEPSEGSAPGTSESATPESGPGSEPATS GSETPGTSESATPESGPGSEPATSGSETPGTSESATPESGPGTSTE PSEGSAPGSPAGSPTSTEEGTSESATPESGPGSEPATSGSETPGTS ESATPESGPGSPAGSPTSTEEGSPAGSPTSTEEGTSTEPSEGSAPG TSESATPESGPGTSESATPESGPGTSESATPESGPGSEPATSGSET PGSEPATSGSETPGSPAGSPTSTEEGTSTEPSEGSAPGTSTEPSEG SAPGSEPATSGSETPGTSESATPESGPGTSTEPSEGSAPGLSGRSD NHSPLGLAGSGTAEAASASGELVMTQSPSSLTVTAGEKVTMSCKSS QSLLNSGNQKNYLTWYQQKPGQPPKLLIYWASTRESGVPDRFTGSG SGTDFTLTISSVQAEDLAVYYCQNDYSYPLTFGAGTKLEIKGGGGS GGGGSGGGGSEVQLLEQSGAELVRPGTSVKISCKASGYAFTNYWLG WVKQRPGHGLEWIGDIFPGSGNIHYNEKFKGKATLTADKSSSTAYM QLSSLTFEDSAVYFCARLRNWDEPMDYWGQGTTVTVSSGGGGSDVQ LVQSGAEVKKPGASVKVSCKASGYTFTRYTMHWVRQAPGQGLEWIG YINPSRGYTNYADSVKGRFTITTDKSTSTAYMELSSLRSEDTATYY CARYYDDHYCLDYWGQGTTVTVSSGEGTSTGSGGSGGSGGADDIVL TQSPATLSLSPGERATLSCRASQSVSYMNWYQQKPGKAPKRWIYDT SKVASGVPARFSGSGSGTDYSLTINSLEAEDAATYYCQQWSSNPLT FGGGTKVEIKHHHHHHHH | |
| AC1411 | EpCAM | HHHHHHHHELVMTQSPSSLTVTAGEKVTMSCKSSQSLLNSGNQKNY LTWYQQKPGQPPKLLIYWASTRESGVPDRFTGSGSGTDFTLTISSV QAEDLAVYYCQNDYSYPLTFGAGTKLEIKGGGGSGGGGSGGGGSEV QLLEQSGAELVRPGTSVKISCKASGYAFTNYWLGWVKQRPGHGLEW IGDIFPGSGNIHYNEKFKGKATLTADKSSSTAYMQLSSLTFEDSAV YFCARLRNWDEPMDYWGQGTTVTVSSGGGGSDIVLTQSPATLSLSP GERATLSCRASQSVSYMNWYQQKPGKAPKRWIYDTSKVASGVPARF SGSGSGTDYSLTINSLEAEDAATYYCQQWSSNPLTFGGGTKVEIKG EGTSTGSGGSGGSGGADDVQLVQSGAEVKKPGASVKVSCKASGYTF TRYTMHWVRQAPGQGLEWIGYINPSRGYTNYADSVKGRFTITTDKS TSTAYMELSSLRSEDTATYYCARYYDDHYCLDYWGQGTTVTVSSGT AEAASASGLSGRSDNHSPLGLAGSPGSPAGSPTSTEEGTSESATPE SGPGTSTEPSEGSAPGSPAGSPTSTEEGTSTEPSEGSAPGTSTEPS EGSAPGTSESATPESGPGSEPATSGSETPGSEPATSGSETPGSPAG SPTSTEEGTSESATPESGPGTSTEPSEGSAPGTSTEPSEGSAPGSP AGSPTSTEEGTSTEPSEGSAPGTSTEPSEGSAPGTSESATPESGPG TSTEPSEGSAPGTSESATPESGPGSEPATSGSETPGTSTEPSEGSA PGTSTEPSEGSAPGTSESATPESGPGTSESATPESGPGSPAGSPTS TEEGTSESATPESGPGSEPATSGSETPGTSESATPESGPGTSTEPS EGSAPGTSTEPSEGSAPGTSTEPSEGSAPGTSTEPSEGSAPGTSTE PSEGSAPGTSTEPSEGSAPGSPAGSPTSTEEGTSTEPSEGSAPGTS ESATPESGPGSEPATSGSETPGTSESATPESGPGSEPATSGSETPG TSESATPESGPGTSTEPSEGSAPGTSESATPESGPGSPAGSPTSTE EGSPAGSPTSTEEGSPAGSPTSTEEGTSESATPESGPGTSTEPSEG SAPGTSESATPESGPGSEPATSGSETPGTSESATPESGPGSEPATS GSETPGTSESATPESGPGTSTEPSEGSAPGSPAGSPTSTEEGTSES ATPESGPGSEPATSGSETPGTSESATPESGPGSPAGSPTSTEEGSP AGSPTSTEEGTSTEPSEGSAPGTSESATPESGPGTSESATPESGPG TSESATPESGPGSEPATSGSETPGSEPATSGSETPGSPAGSPTSTE EGTSTEPSEGSAPGTSTEPSEGSAPGSEPATSGSETPGTSESATPE SGPGTSTEPSEGSAPG | 494 |
| AC1412 | EpCAM | HHHHHHHHEVQLLEQSGAELVRPGTSVKISCKASGYAFTNYWLGWV KQRPGHGLEWIGDIFPGSGNIHYNEKFKGKATLTADKSSSTAYMQL SSLTFEDSAVYFCARLRNWDEPMDYWGQGTTVTVSSGGGGSGGGGS GGGGSELVMTQSPSSLTVTAGEKVTMSCKSSQSLLNSGNQKNYLTW YQQKPGQPPKLLIYWASTRESGVPDRFTGSGSGTDFTLTISSVQAE DLAVYYCQNDYSYPLTFGAGTKLEIKGGGGSDVQLVQSGAEVKKPG ASVKVSCKASGYTFTRYTMHWVRQAPGQGLEWIGYINPSRGYTNYA DSVKGRFTITTDKSTSTAYMELSSLRSEDTATYYCARYYDDHYCLD YWGQGTTVTVSSGEGTSTGSGGSGGSGGADDIVLTQSPATLSLSPG ERATLSCRASQSVSYMNWYQQKPGKAPKRWIYDTSKVASGVPARFS GSGSGTDYSLTINSLEAEDAATYYCQQWSSNPLTFGGGTKVEIKGT AEAASASGLSGRSDNHSPLGLAGSPGSPAGSPTSTEEGTSESATPE SGPGTSTEPSEGSAPGSPAGSPTSTEEGTSTEPSEGSAPGTSTEPS EGSAPGTSESATPESGPGSEPATSGSETPGSEPATSGSETPGSPAG SPTSTEEGTSESATPESGPGTSTEPSEGSAPGTSTEPSEGSAPGSP | 495 |

TABLE 12-continued

Chimeric Polypeptide Assembly Sequences

| Construct ID | Tumor Targets | Amino Acid Sequences | SEQ ID NO: |
|---|---|---|---|
| | | AGSPTSTEEGTSTEPSEGSAPGTSTEPSEGSAPGTSESATPESGPG<br>TSTEPSEGSAPGTSESATPESGPGSEPATSGSETPGTSTEPSEGSA<br>PGTSTEPSEGSAPGTSESATPESGPGTSESATPESGPGSPAGSPTS<br>TEEGTSESATPESGPGSEPATSGSETPGTSESATPESGPGTSTEPS<br>EGSAPGTSTEPSEGSAPGTSTEPSEGSAPGTSTEPSEGSAPGTSTE<br>PSEGSAPGTSTEPSEGSAPGSPAGSPTSTEEGTSTEPSEGSAPGTS<br>ESATPESGPGSEPATSGSETPGTSESATPESGPGSEPATSGSETPG<br>TSESATPESGPGTSTEPSEGSAPGTSESATPESGPGSPAGSPTSTE<br>EGSPAGSPTSTEEGSPAGSPTSTEEGTSESATPESGPGTSTEPSEG<br>SAPGTSESATPESGPGSEPATSGSETPGTSESATPESGPGSEPATS<br>GSETPGTSESATPESGPGTSTEPSEGSAPGSPAGSPTSTEEGTSES<br>ATPESGPGSEPATSGSETPGTSESATPESGPGSPAGSPTSTEEGSP<br>AGSPTSTEEGTSTEPSEGSAPGTSESATPESGPGTSESATPESGPG<br>TSESATPESGPGSEPATSGSETPGSEPATSGSETPGSPAGSPTSTE<br>EGTSTEPSEGSAPGTSTEPSEGSAPGSEPATSGSETPGTSESATPE<br>SGPGTSTEPSEGSAPG | |
| AC1413 | EpCAM | HHHHHHHHDVQLVQSGAEVKKPGASVKVSCKASGYTFTRYTMHWVR<br>QAPGQGLEWIGYINPSRGYTNYADSVKGRFTITTDKSTSTAYMELS<br>SLRSEDTATYYCARYYDDHYCLDYWGQGTTVTVSSGEGTSTGSGGS<br>GGSGGADDIVLTQSPATLSLSPGERATLSCRASQSVSYMNWYQQKP<br>GKAPKRWIYDTSKVASGVPARFSGSGSGTDYSLTINSLEAEDAATY<br>YCQQWSSNPLTFGGGTKVEIKGGGGSELVMTQSPSSLTVTAGEKVT<br>MSCKSSQSLLNSGNQKNYLTWYQQKPGQPPKLLIYWASTRESGVPD<br>RFTGSGSGTDFTLTISSVQAEDLAVYYCQNDYSYPLTFGAGTKLEI<br>KGGGGSGGGGSGGGGSEVQLLEQSGAELVRPGTSVKISCKASGYAF<br>TNYWLGWVKQRPGHGLEWIGDIFPGSGNIHYNEKFKGKATLTADKS<br>SSTAYMQLSSLTFEDSAVYFCARLRNWDEPMDYWGQGTTVTVSSGT<br>AEAASASGLSGRSDNHSPLGLAGSPGSPAGSPTSTEEGTSESATPE<br>SGPGTSTEPSEGSAPGSPAGSPTSTEEGTSTEPSEGSAPGTSTEPS<br>EGSAPGTSESATPESGPGSEPATSGSETPGSEPATSGSETPGSPAG<br>SPTSTEEGTSESATPESGPGTSTEPSEGSAPGTSTEPSEGSAPGSP<br>AGSPTSTEEGTSTEPSEGSAPGTSTEPSEGSAPGTSESATPESGPG<br>TSTEPSEGSAPGTSESATPESGPGSEPATSGSETPGTSTEPSEGSA<br>PGTSTEPSEGSAPGTSESATPESGPGTSESATPESGPGSPAGSPTS<br>TEEGTSESATPESGPGSEPATSGSETPGTSESATPESGPGTSTEPS<br>EGSAPGTSTEPSEGSAPGTSTEPSEGSAPGTSTEPSEGSAPGTSTE<br>PSEGSAPGTSTEPSEGSAPGSPAGSPTSTEEGTSTEPSEGSAPGTS<br>ESATPESGPGSEPATSGSETPGTSESATPESGPGSEPATSGSETPG<br>TSESATPESGPGTSTEPSEGSAPGTSESATPESGPGSPAGSPTSTE<br>EGSPAGSPTSTEEGSPAGSPTSTEEGTSESATPESGPGTSTEPSEG<br>SAPGTSESATPESGPGSEPATSGSETPGTSESATPESGPGSEPATS<br>GSETPGTSESATPESGPGTSTEPSEGSAPGSPAGSPTSTEEGTSES<br>ATPESGPGSEPATSGSETPGTSESATPESGPGSPAGSPTSTEEGSP<br>AGSPTSTEEGTSTEPSEGSAPGTSESATPESGPGTSESATPESGPG<br>TSESATPESGPGSEPATSGSETPGSEPATSGSETPGSPAGSPTSTE<br>EGTSTEPSEGSAPGTSTEPSEGSAPGSEPATSGSETPGTSESATPE<br>SGPGTSTEPSEGSAPG | 496 |
| AC1414 | EpCAM | HHHHHHHHDIVLTQSPATLSLSPGERATLSCRASQSVSYMNWYQQK<br>PGKAPKRWIYDTSKVASGVPARFSGSGSGTDYSLTINSLEAEDAAT<br>YYCQQWSSNPLTFGGGTKVEIKGEGTSTGSGGSGGSGGADDVQLVQ<br>SGAEVKKPGASVKVSCKASGYTFTRYTMHWVRQAPGQGLEWIGYIN<br>PSRGYTNYADSVKGRFTITTDKSTSTAYMELSSLRSEDTATYYCAR<br>YYDDHYCLDYWGQGTTVTVSSGGGGSELVMTQSPSSLTVTAGEKVT<br>MSCKSSQSLLNSGNQKNYLTWYQQKPGQPPKLLIYWASTRESGVPD<br>RFTGSGSGTDFTLTISSVQAEDLAVYYCQNDYSYPLTFGAGTKLEI<br>KGGGGSGGGGSGGGGSEVQLLEQSGAELVRPGTSVKISCKASGYAF<br>TNYWLGWVKQRPGHGLEWIGDIFPGSGNIHYNEKFKGKATLTADKS<br>SSTAYMQLSSLTFEDSAVYFCARLRNWDEPMDYWGQGTTVTVSSGT<br>AEAASASGLSGRSDNHSPLGLAGSPGSPAGSPTSTEEGTSESATPE<br>SGPGTSTEPSEGSAPGSPAGSPTSTEEGTSTEPSEGSAPGTSTEPS<br>EGSAPGTSESATPESGPGSEPATSGSETPGSEPATSGSETPGSPAG<br>SPTSTEEGTSESATPESGPGTSTEPSEGSAPGTSTEPSEGSAPGSP<br>AGSPTSTEEGTSTEPSEGSAPGTSTEPSEGSAPGTSESATPESGPG<br>TSTEPSEGSAPGTSESATPESGPGSEPATSGSETPGTSTEPSEGSA<br>PGTSTEPSEGSAPGTSESATPESGPGTSESATPESGPGSPAGSPTS<br>TEEGTSESATPESGPGSEPATSGSETPGTSESATPESGPGTSTEPS<br>EGSAPGTSTEPSEGSAPGTSTEPSEGSAPGTSTEPSEGSAPGTSTE<br>PSEGSAPGTSTEPSEGSAPGSPAGSPTSTEEGTSTEPSEGSAPGTS<br>ESATPESGPGSEPATSGSETPGTSESATPESGPGSEPATSGSETPG<br>TSESATPESGPGTSTEPSEGSAPGTSESATPESGPGSPAGSPTSTE<br>EGSPAGSPTSTEEGSPAGSPTSTEEGTSESATPESGPGTSTEPSEG<br>SAPGTSESATPESGPGSEPATSGSETPGTSESATPESGPGSEPATS | 497 |

TABLE 12-continued

Chimeric Polypeptide Assembly Sequences

| Construct ID | Tumor Targets | Amino Acid Sequences | SEQ ID NO: |
|---|---|---|---|
| | | GSETPGTSESATPESGPGTSTEPSEGSAPGSPAGSPTSTEEGTSES ATPESGPGSEPATSGSETPGTSESATPESGPGSPAGSPTSTEEGSP AGSPTSTEEGTSTEPSEGSAPGTSESATPESGPGTSESATPESGPG TSESATPESGPGSEPATSGSETPGSEPATSGSETPGSPAGSPTSTE EGTSTEPSEGSAPGTSTEPSEGSAPGSEPATSGSETPGTSESATPE SGPGTSTEPSEGSAPG | |
| AC1476 | EpCAM | DIQMTQSPSSLSASVGDRVTITCRSTKSLLHSNGITYLYWYQQKPG KAPKLLIYQMSNLASGVPSRFSSSGSGTDFTLTISSLQPEDFATYY CAQNLEIPRTFGQGTKVEIKGATPPETGAETESPGETTGGSAESEP PGEGQVQLVQSGPGLVQPGGSVRISCAASGYTFTNYGMNWVKQAPG KGLEWMGWINTYTGESTYADSFKGRFTFSLDTSASAAYLQINSLRA EDTAVYYCARFAIKGDYWGQGTLLTVSSGGGGSDIQMTQSPSSLSA SVGDRVTITCRASQDIRNYLNWYQQKPGKAPKLLIYYTSRLESGVP SRFSGSGSGTDYTLTISSLQPEDFATYYCQQGNTLPWTFGQGTKVE IKGATPPETGAETESPGETTGGSAESEPPGEGEVQLVESGGGLVQP GGSLRLSCAASGYSFTGYTMNWVRQAPGKGLEWVALINPYKGVSTY NQKFKDRFTISVDKSKNTAYLQMNSLRAEDTAVYYCARSGYYGDSD WYFDVWGQGTLVTVSSGTAEAASASGLSGRSDNHSPLGLAGSPGSP AGSPTSTEEGTSESATPESGPGTSTEPSEGSAPGSPAGSPTSTEEG TSTEPSEGSAPGTSTEPSEGSAPGTSESATPESGPGSEPATSGSET PGSEPATSGSETPGSPAGSPTSTEEGTSESATPESGPGTSTEPSEG SAPGTSTEPSEGSAPGSPAGSPTSTEEGTSTEPSEGSAPGTSTEPS EGSAPGTSESATPESGPGTSTEPSEGSAPGTSESATPESGPGSEPA TSGSETPGTSTEPSEGSAPGTSTEPSEGSAPGTSESATPESGPGTS ESATPESGPGSPAGSPTSTEEGTSESATPESGPGSEPATSGSETPG TSESATPESGPGTSTEPSEGSAPGTSTEPSEGSAPGTSTEPSEGSA PGTSTEPSEGSAPGTSTEPSEGSAPGTSTEPSEGSAPGSPAGSPTS TEEGTSTEPSEGSAPGTSESATPESGPGSEPATSGSETPGTSESAT PESGPGSEPATSGSETPGTSESATPESGPGTSTEPSEGSAPGTSES ATPESGPGSPAGSPTSTEEGSPAGSPTSTEEGSPAGSPTSTEEGTS ESATPESGPGTSTEPSEGSAPGTSESATPESGPGSEPATSGSETPG TSESATPESGPGSEPATSGSETPGTSESATPESGPGTSTEPSEGSA PGSPAGSPTSTEEGTSESATPESGPGSEPATSGSETPGTSESATPE SGPGSPAGSPTSTEEGSPAGSPTSTEEGTSTEPSEGSAPGTSESAT PESGPGTSESATPESGPGTSESATPESGPGSEPATSGSETPGSEPA TSGSETPGSPAGSPTSTEEGTSTEPSEGSAPGTSTEPSEGSAPGSE PATSGSETPGTSESATPESGPGTSTEPSEGSAPGHHHHHH | 498 |
| AC1484 | EpCAM | DIQMTQSPSSLSASVGDRVTITCRSTKSLLHSNGITYLYWYQQKPG KAPKLLIYQMSNLASGVPSRFSSSGSGTDFTLTISSLQPEDFATYY CAQNLEIPRTFGQGTKVEIKGATPPETGAETESPGETTGGSAESEP PGEGQVQLVQSGPGLVQPGGSVRISCAASGYTFTNYGMNWVKQAPG KGLEWMGWINTYTGESTYADSFKGRFTFSLDTSASAAYLQINSLRA EDTAVYYCARFAIKGDYWGQGTLLTVSSGGGGSDIQMTQSPSSLSA SVGDRVTITCRASQDIRNYLNWYQQKPGKAPKLLIYYTSRLESGVP SRFSGSGSGTDYTLTISSLQPEDFATYYCQQGNTLPWTFGQGTKVE IKGATPPETGAETESPGETTGGSAESEPPGEGEVQLVESGGGLVQP GGSLRLSCAASGYSFTGYTMNWVRQAPGKGLEWVALINPYKGVSTY NQKFKDRFTISVDKSKNTAYLQMNSLRAEDTAVYYCARSGYYGDSD WYFDVWGQGTLVTVSSGSPGSPAGSPTSTEEGTSESATPESGPGTS TEPSEGSAPGSPAGSPTSTEEGTSTEPSEGSAPGTSTEPSEGSAPG TSESATPESGPGSEPATSGSETPGSEPATSGSETPGSPAGSPTSTE EGTSESATPESGPGTSTEPSEGSAPGTSTEPSEGSAPGSPAGSPTS TEEGTSTEPSEGSAPGTSTEPSEGSAPGTSESATPESGPGTSTEPS EGSAPGTSESATPESGPGSEPATSGSETPGTSTEPSEGSAPGTSTE PSEGSAPGTSESATPESGPGTSESATPESGPGSPAGSPTSTEEGTS ESATPESGPGSEPATSGSETPGTSESATPESGPGTSTEPSEGSAPG TSTEPSEGSAPGTSTEPSEGSAPGTSTEPSEGSAPGTSTEPSEGSA PGTSTEPSEGSAPGSPAGSPTSTEEGTSTEPSEGSAPGTSESATPE SGPGSEPATSGSETPGTSESATPESGPGSEPATSGSETPGTSESAT PESGPGTSTEPSEGSAPGTSESATPESGPGSPAGSPTSTEEGSPAG SPTSTEEGSPAGSPTSTEEGTSESATPESGPGTSTEPSEGSAPGTS ESATPESGPGSEPATSGSETPGTSESATPESGPGSEPATSGSETPG TSESATPESGPGTSTEPSEGSAPGSPAGSPTSTEEGTSESATPESG PGSEPATSGSETPGTSESATPESGPGSPAGSPTSTEEGSPAGSPTS TEEGTSTEPSEGSAPGTSESATPESGPGTSESATPESGPGTSESAT PESGPGSEPATSGSETPGSEPATSGSETPGSPAGSPTSTEEGTSTE PSEGSAPGTSTEPSEGSAPGSEPATSGSETPGTSESATPESGPGTS TEPSEGSAPGHHHHHH | 499 |
| AC1489 | EpCAM | DIVMTQSPLSLPVTPGEPASISCRSSKNLLHSNGITYLYWYLQKPG QSPQLLIYQMSNLASGVPDRFSSSGSGTDFTLKISRVEAEDVGVYY CAQNLEIPRTFGQGTKVEIKGATPPETGAETESPGETTGGSAESEP | 500 |

TABLE 12-continued

Chimeric Polypeptide Assembly Sequences

| Construct ID | Tumor Targets | Amino Acid Sequences | SEQ ID NO: |
|---|---|---|---|
| | | PGEGQVQLVQSGPEVKKPGASVKVSCKASGYTFTNYGMNWVRQAPG QGLEWMGWINTYTGEPTYGEDFKGRFAFSLDTSASTAYMELSSLRS EDTAVYFCARFGNYVDYWGQGSLVTVSSGGGGSELVVTQEPSLTVS PGGTVTLTCRSSTGAVTTSNYANWVQQKPGQAPRGLIGGTNKRAPG TPARFSGSLLGGKAALTLSGVQPEDEAEYYCALWYSNLWVFGGGTK LTVLGATPPETGAETESPGETTGGSAESEPPGEGEVQLLESGGGLV QPGGSLKLSCAASGFTFNTYAMNWVRQAPGKGLEWVARIRSKYNNY ATYYADSVKDRFTISRDDSKNTAYLQMNNLKTEDTAVYYCVRHGNF GNSYVSWFAYWGQGTLVTVSSGTAEAASASGLSGRSDNHSPLGLAG SPGSPAGSPTSTEEGTSESATPESGPGTSTEPSEGSAPGSPAGSPT STEEGTSTEPSEGSAPGTSTEPSEGSAPGTSESATPESGPGSEPAT SGSETPGSEPATSGSETPGSPAGSPTSTEEGTSESATPESGPGTST EPSEGSAPGTSTEPSEGSAPGSPAGSPTSTEEGTSTEPSEGSAPGT STEPSEGSAPGTSESATPESGPGTSTEPSEGSAPGTSESATPESGP GSEPATSGSETPGTSTEPSEGSAPGTSTEPSEGSAPGTSESATPES GPGTSESATPESGPGSPAGSPTSTEEGTSESATPESGPGSEPATSG SETPGTSESATPESGPGTSTEPSEGSAPGTSTEPSEGSAPGTSTEP SEGSAPGTSTEPSEGSAPGTSTEPSEGSAPGTSTEPSEGSAPGSPA GSPTSTEEGTSTEPSEGSAPGTSESATPESGPGSEPATSGSETPGT SESATPESGPGSEPATSGSETPGTSESATPESGPGTSTEPSEGSAP GTSESATPESGPGSPAGSPTSTEEGSPAGSPTSTEEGSPAGSPTST EEGTSESATPESGPGTSTEPSEGSAPGTSESATPESGPGSEPATSG SETPGTSESATPESGPGSEPATSGSETPGTSESATPESGPGTSTEP SEGSAPGSPAGSPTSTEEGTSESATPESGPGSEPATSGSETPGTSE SATPESGPGSPAGSPTSTEEGSPAGSPTSTEEGTSTEPSEGSAPGT SESATPESGPGTSESATPESGPGTSESATPESGPGSEPATSGSETP GSEPATSGSETPGSPAGSPTSTEEGTSTEPSEGSAPGTSTEPSEGS APGSEPATSGSETPGTSESATPESGPGTSTEPSEGSAPGHHHHHH | |
| AC1490 | EpCAM | DIVMTQSPLSLPVTPGEPASISCRSSKNLLHSNGITYLYWYLQKPG QSPQLLIYQMSNLASGVPDRFSSSGSGTDFTLKISRVEAEDVGVYY CAQNLEIPRTFGQGTKVEIKGATPPETGAETESPGETTGGSAESEP PGEGQVQLVQSGPEVKKPGASVKVSCKASGYTFTNYGMNWVRQAPG QGLEWMGWINTYTGEPTYGEDFKGRFAFSLDTSASTAYMELSSLRS EDTAVYFCARFGNYVDYWGQGSLVTVSSGGGGSELVVTQEPSLTVS PGGTVTLTCRSSTGAVTTSNYANWVQQKPGQAPRGLIGGTNKRAPG TPARFSGSLLGGKAALTLSGVQPEDEAEYYCALWYSNLWVFGGGTK LTVLGATPPETGAETESPGETTGGSAESEPPGEGEVQLLESGGGLV QPGGSLKLSCAASGFTFNTYAMNWVRQAPGKGLEWVARIRSKYNNY ATYYADSVKDRFTISRDDSKNTAYLQMNNLKTEDTAVYYCVRHGNF GNSYVSWFAYWGQGTLVTVSSGSPGSPAGSPTSTEEGTSESATPES GPGTSTEPSEGSAPGSPAGSPTSTEEGTSTEPSEGSAPGTSTEPSE GSAPGTSESATPESGPGSEPATSGSETPGSEPATSGSETPGSPAGS PTSTEEGTSESATPESGPGTSTEPSEGSAPGTSTEPSEGSAPGSPA GSPTSTEEGTSTEPSEGSAPGTSTEPSEGSAPGTSESATPESGPGT STEPSEGSAPGTSESATPESGPGSEPATSGSETPGTSTEPSEGSAP GTSTEPSEGSAPGTSESATPESGPGTSESATPESGPGSPAGSPTST EEGTSESATPESGPGSEPATSGSETPGTSESATPESGPGTSTEPSE GSAPGTSTEPSEGSAPGTSTEPSEGSAPGTSTEPSEGSAPGTSTEP SEGSAPGTSTEPSEGSAPGSPAGSPTSTEEGTSTEPSEGSAPGTSE SATPESGPGSEPATSGSETPGTSESATPESGPGSEPATSGSETPGT SESATPESGPGTSTEPSEGSAPGTSESATPESGPGSPAGSPTSTEE GSPAGSPTSTEEGSPAGSPTSTEEGTSESATPESGPGTSTEPSEGS APGTSESATPESGPGSEPATSGSETPGTSESATPESGPGSEPATSG SETPGTSESATPESGPGTSTEPSEGSAPGSPAGSPTSTEEGTSESA TPESGPGSEPATSGSETPGTSESATPESGPGSPAGSPTSTEEGSPA GSPTSTEEGTSTEPSEGSAPGTSESATPESGPGTSESATPESGPGT SESATPESGPGSEPATSGSETPGSEPATSGSETPGSPAGSPTSTEE GTSTEPSEGSAPGTSTEPSEGSAPGSEPATSGSETPGTSESATPES GPGTSTEPSEGSAPGHHHHHH | 501 |
| AC1507 | EpCAM | HHHHHHGGSPAGSPTSTEEGTSESATPESGPGTSTEPSEGSAPGSP AGSPTSTEEGTSTEPSEGSAPGTSTEPSEGSAPGTSESATPESGPG SEPATSGSETPGSEPATSGSETPGSPAGSPTSTEEGTSESATPESG PGTSTEPSEGSAPGTSTEPSEGSAPGSPAGSPTSTEEGTSTEPSEG SAPGTSTEPSEGSAPGTSESATPESGPGTSTEPSEGSAPGTSESAT PESGPGSEPATSGSETPGTSTEPSEGSAPGTSTEPSEGSAPGTSES ATPESGPGTSESATPESGPGSPAGSPTSTEEGTSESATPESGPGSE PATSGSETPGTSESATPESGPGTSTEPSEGSAPGTSTEPSEGSAPG TSTEPSEGSAPGTSTEPSEGSAPGTSTEPSEGSAPGTSTEPSEGSA PGSPAGSPTSTEEGTSTEPSEGSAPGTSESATPESGPGSEPATSGS ETPGTSESATPESGPGSEPATSGSETPGTSESATPESGPGTSTEPS EGSAPGTSESATPESGPGSPAGSPTSTEEGSPAGSPTSTEEGSPAG SPTSTEEGTSESATPESGPGTSTEPSEGSAPGTSESATPESGPGSE | 502 |

TABLE 12-continued

Chimeric Polypeptide Assembly Sequences

| Construct ID | Tumor Targets | Amino Acid Sequences | SEQ ID NO: |
|---|---|---|---|
| | | PATSGSETPGTSESATPESGPGSEPATSGSETPGTSESATPESGPG TSTEPSEGSAPGSPAGSPTSTEEGTSESATPESGPGSEPATSGSET PGTSESATPESGPGSPAGSPTSTEEGSPAGSPTSTEEGTSTEPSEG SAPGSESATPESGPGTSESATPESGPGTSESATPESGPGSEPATS GSETPGSEPATSGSETPGSPAGSPTSTEEGTSTEPSEGSAPGTSTE PSEGSAPGSEPATSGSETPGTSESATPESGPGTSTEPSEGSAPLSG RSDNHSPLGLAGSGTAEAASASGDIQMTQSPSSLSASVGDRVTITC RASQDIRNYLNWYQQKPGKAPKLLIYYTSRLESGVPSRFSGSGSGT DYTLTISSLQPEDFATYYCQQGNTLPWTFGQGTKVEIKGATPPETG AETESPGETTGGSAESEPPGEGEVQLVESGGGLVQPGGSLRLSCAA SGYSFTGYTMNWVRQAPGKGLEWVALINPYKGVSTYNQKFKDRFTI SVDKSKNTAYLQMNSLRAEDTAVYYCARSGYYGDSDWYFDVWGQGT LVTVSSGGGGSDIQMTQSPSSLSASVGDRVTITCRSTKSLLHSNGI TYLYWYQQKPGKAPKLLIYQMSNLASGVPSRFSSSGSGTDFTLTIS SLQPEDFATYYCAQNLEIPRTFGQGTKVEIKGATPPETGAETESPG ETTGGSAESEPPGEGQVQLVQSGPGLVQPGGSVRISCAASGYTFTN YGMNWVKQAPGKGLEWMGWINTYTGESTYADSFKGRFTFSLDTSAS AAYLQINSLRAEDTAVYYCARFAIKGDYWGQGTLLTVSS | |
| AC1510 | EpCAM | HHHHHHGGSPAGSPTSTEEGTSESATPESGPGTSTEPSEGSAPGSP AGSPTSTEEGTSTEPSEGSAPGTSTEPSEGSAPGTSESATPESGPG SEPATSGSETPGSEPATSGSETPGSPAGSPTSTEEGTSESATPESG PGTSTEPSEGSAPGTSTEPSEGSAPGSPAGSPTSTEEGTSTEPSEG SAPGTSTEPSEGSAPGTSESATPESGPGTSTEPSEGSAPGTSESAT PESGPGSEPATSGSETPGTSTEPSEGSAPGTSTEPSEGSAPGTSES ATPESGPGTSESATPESGPGSPAGSPTSTEEGTSESATPESGPGSE PATSGSETPGTSESATPESGPGTSTEPSEGSAPGTSTEPSEGSAPG TSTEPSEGSAPGTSTEPSEGSAPGTSTEPSEGSAPGTSTEPSEGSA PGSPAGSPTSTEEGTSTEPSEGSAPGTSESATPESGPGSEPATSGS ETPGTSESATPESGPGSEPATSGSETPGTSESATPESGPGTSTEPS EGSAPGTSESATPESGPGSPAGSPTSTEEGSPAGSPTSTEEGSPAG SPTSTEEGTSESATPESGPGTSTEPSEGSAPGTSESATPESGPGSE PATSGSETPGTSESATPESGPGSEPATSGSETPGTSESATPESGPG TSTEPSEGSAPGSPAGSPTSTEEGTSESATPESGPGSEPATSGSET PGTSESATPESGPGSPAGSPTSTEEGSPAGSPTSTEEGTSTEPSEG SAPGTSESATPESGPGTSESATPESGPGTSESATPESGPGSEPATS GSETPGSEPATSGSETPGSPAGSPTSTEEGTSTEPSEGSAPGTSTE PSEGSAPGSEPATSGSETPGTSESATPESGPGTSTEPSEGSAPGSP DIQMTQSPSSLSASVGDRVTITCRASQDIRNYLNWYQQKPGKAPKL LIYYTSRLESGVPSRFSGSGSGTDYTLTISSLQPEDFATYYCQQGN TLPWTFGQGTKVEIKGATPPETGAETESPGETTGGSAESEPPGEGE VQLVESGGGLVQPGGSLRLSCAASGYSFTGYTMNWVRQAPGKGLEW VALINPYKGVSTYNQKFKDRFTISVDKSKNTAYLQMNSLRAEDTAV YYCARSGYYGDSDWYFDVWGQGTLVTVSSGGGGSDIQMTQSPSSLS ASVGDRVTITCRSTKSLLHSNGITYLYWYQQKPGKAPKLLIYQMSN LASGVPSRFSSSGSGTDFTLTISSLQPEDFATYYCAQNLEIPRTFG QGTKVEIKGATPPETGAETESPGETTGGSAESEPPGEGQVQLVQSG PGLVQPGGSVRISCAASGYTFTNYGMNWVKQAPGKGLEWMGWINTY TGESTYADSFKGRFTFSLDTSASAAYLQINSLRAEDTAVYYCARFA IKGDYWGQGTLLTVSS | 503 |
| AC1501 | HER2 | DIQMTQSPSSLSASVGDRVTITCRASQDVNTAVAWYQQKPGKAPKL LIYSASFLYSGVPSRFSGSRSGTDFTLTISSLQPEDFATYYCQQHY TTPPTFGQGTKVEIKGATPPETGAETESPGETTGGSAESEPPGEGE VQLVESGGGLVQPGGSLRLSCAASGFNIKDTYIHWVRQAPGKGLEW VARIYPTNGYTRYADSVKGRFTISADTSKNTAYLQMNSLRAEDTAV YYCSRWGGDGFYAMDYWGQGTLVTVSSGGGGSDIQMTQSPSSLSAS VGDRVTITCRASQDIRNYLNWYQQKPGKAPKLLIYYTSRLESGVPS RFSGSGSGTDYTLTISSLQPEDFATYYCQQGNTLPWTFGQGTKVEI KGATPPETGAETESPGETTGGSAESEPPGEGEVQLVESGGGLVQPG GSLRLSCAASGYSFTGYTMNWVRQAPGKGLEWVALINPYKGVSTYN QKFKDRFTISVDKSKNTAYLQMNSLRAEDTAVYYCARSGYYGDSDW YFDVWGQGTLVTVSSGTAEAASASGLSGRSDNHSPLGLAGSPGSPA GSPTSTEEGTSESATPESGPGTSTEPSEGSAPGSPAGSPTSTEEGT STEPSEGSAPGTSTEPSEGSAPGTSESATPESGPGSEPATSGSETP GSEPATSGSETPGSPAGSPTSTEEGTSESATPESGPGTSTEPSEGS APGTSTEPSEGSAPGSPAGSPTSTEEGTSTEPSEGSAPGTSTEPSE GSAPGTSESATPESGPGTSTEPSEGSAPGTSESATPESGPGSEPAT SGSETPGTSTEPSEGSAPGTSTEPSEGSAPGTSESATPESGPGTSE SATPESGPGSPAGSPTSTEEGTSESATPESGPGSEPATSGSETPGT SESATPESGPGTSTEPSEGSAPGTSTEPSEGSAPGTSTEPSEGSAP GTSTEPSEGSAPGTSTEPSEGSAPGTSTEPSEGSAPGSPAGSPTST EEGTSTEPSEGSAPGTSESATPESGPGSEPATSGSETPGTSESATP ESGPGSEPATSGSETPGTSESATPESGPGTSTEPSEGSAPGTSESA | 504 |

TABLE 12-continued

Chimeric Polypeptide Assembly Sequences

| Construct ID | Tumor Targets | Amino Acid Sequences | SEQ ID NO: |
|---|---|---|---|
| | | TPESGPGSPAGSPTSTEEGSPAGSPTSTEEGSPAGSPTSTEEGTSE SATPESGPGTSTEPSEGSAPGTSESATPESGPGSEPATSGSETPGT SESATPESGPGSEPATSGSETPGTSESATPESGPGTSTEPSEGSAP GSPAGSPTSTEEGTSESATPESGPGSEPATSGSETPGTSESATPES GPGSPAGSPTSTEEGSPAGSPTSTEEGTSTEPSEGSAPGTSESATP ESGPGTSESATPESGPGTSESATPESGPGSEPATSGSETPGSEPAT SGSETPGSPAGSPTSTEEGTSTEPSEGSAPGTSTEPSEGSAPGSEP ATSGSETPGTSESATPESGPGTSTEPSEGSAPGHHHHHH | |
| AC1502 | HER2 | DIQMTQSPSSLSASVGDRVTITCRASQDVNTAVAWYQQKPGKAPKL LIYSASFLYSGVPSRFSGSRSGTDFTLTISSLQPEDFATYYCQQHY TTPPTFGQGTKVEIKGATPPETGAETESPGETTGGSAESEPPGEGE VQLVESGGGLVQPGGSLRLSCAASGFNIKDTYIHWVRQAPGKGLEW VARIYPTNGYTRYADSVKGRFTISADTSKNTAYLQMNSLRAEDTAV YYCSRWGGDGFYAMDYWGQGTLVTVSSGGGGSDIQMTQSPSSLSAS VGDRVTITCRASQDIRNYLNWYQQKPGKAPKLLIYYTSRLESGVPS RFSGSGSGTDYTLTISSLQPEDFATYYCQQGNTLPWTFGQGTKVEI KGATPPETGAETESPGETTGGSAESEPPGEGEVQLVESGGGLVQPG GSLRLSCAASGYSFTGYTMNWVRQAPGKGLEWVALINPYKGVSTYN QKFKDRFTISVDKSKNTAYLQMNSLRAEDTAVYYCARSGYYGDSDW YFDVWGQGTLVTVSSGSPGSPAGSPTSTEEGTSESATPESGPGTST EPSEGSAPGSPAGSPTSTEEGTSTEPSEGSAPGTSTEPSEGSAPGT SESATPESGPGSEPATSGSETPGSEPATSGSETPGSPAGSPTSTEE GTSESATPESGPGTSTEPSEGSAPGTSTEPSEGSAPGSPAGSPTST EEGTSTEPSEGSAPGTSTEPSEGSAPGTSESATPESGPGTSTEPSE GSAPGTSESATPESGPGSEPATSGSETPGTSTEPSEGSAPGTSTEP SEGSAPGTSESATPESGPGTSESATPESGPGSPAGSPTSTEEGTSE SATPESGPGSEPATSGSETPGTSESATPESGPGTSTEPSEGSAPGT STEPSEGSAPGTSTEPSEGSAPGTSTEPSEGSAPGTSTEPSEGSAP GTSTEPSEGSAPGSPAGSPTSTEEGTSTEPSEGSAPGTSESATPES GPGSEPATSGSETPGTSESATPESGPGSEPATSGSETPGTSESATP ESGPGTSTEPSEGSAPGTSESATPESGPGSPAGSPTSTEEGSPAGS PTSTEEGSPAGSPTSTEEGTSESATPESGPGTSTEPSEGSAPGTSE SATPESGPGSEPATSGSETPGTSESATPESGPGSEPATSGSETPGT SESATPESGPGTSTEPSEGSAPGSPAGSPTSTEEGTSESATPESGP GSEPATSGSETPGTSESATPESGPGSPAGSPTSTEEGSPAGSPTST EEGTSTEPSEGSAPGTSESATPESGPGTSESATPESGPGTSESATP ESGPGSEPATSGSETPGSEPATSGSETPGSPAGSPTSTEEGTSTEP SEGSAPGTSTEPSEGSAPGSEPATSGSETPGTSESATPESGPGTST EPSEGSAPGHHHHHH | 505 |
| AC1503 | HER2 | DIQMTQSPSSLSASVGDRVTITCRASQDVNTAVAWYQQKPGKAPKL LIYSASFLYSGVPSRFSGSRSGTDFTLTISSLQPEDFATYYCQQHY TTPPTFGQGTKVEIKGATPPETGAETESPGETTGGSAESEPPGEGE VQLVESGGGLVQPGGSLRLSCAASGFNIKDTYIHWVRQAPGKGLEW VARIYPTNGYTRYADSVKGRFTISADTSKNTAYLQMNSLRAEDTAV YYCSRWGGDGFYAMDYWGQGTLVTVSSGGGGSELVVTQEPSLTVSP GGTVTLTCRSSTGAVTTSNYANWVQQKPGQAPRGLIGGTNKRAPGT PARFSGSLLGGKAALTLSGVQPEDEAEYYCALWYSNLWVFGGGTKL TVLGATPPETGAETESPGETTGGSAESEPPGEGEVQLLESGGGLVQ PGGSLKLSCAASGFTFNTYAMNWVRQAPGKGLEWVARIRSKYNNYA TYYADSVKDRFTISRDDSKNTAYLQMNNLKTEDTAVYYCVRHGNFG NSYVSWFAYWGQGTLVTVSSGTAEAASASGLSGRSDNHSPLGLAGS PGSPAGSPTSTEEGTSESATPESGPGTSTEPSEGSAPGSPAGSPTS TEEGTSTEPSEGSAPGTSTEPSEGSAPGTSESATPESGPGSEPATS GSETPGSEPATSGSETPGSPAGSPTSTEEGTSESATPESGPGTSTE PSEGSAPGTSTEPSEGSAPGSPAGSPTSTEEGTSTEPSEGSAPGTS TEPSEGSAPGTSESATPESGPGTSTEPSEGSAPGTSESATPESGPG SEPATSGSETPGTSTEPSEGSAPGTSTEPSEGSAPGTSESATPESG PGTSESATPESGPSPAGSPTSTEEGTSESATPESGPGSEPATSGS ETPGTSESATPESGPGTSTEPSEGSAPGTSTEPSEGSAPGTSTEPS EGSAPGTSTEPSEGSAPGTSTEPSEGSAPGTSTEPSEGSAPGSPAG SPTSTEEGTSTEPSEGSAPGTSESATPESGPGSEPATSGSETPGTS ESATPESGPGSEPATSGSETPGTSESATPESGPGTSTEPSEGSAPG TSESATPESGPGSPAGSPTSTEEGSPAGSPTSTEEGSPAGSPTSTE EGTSESATPESGPGTSTEPSEGSAPGTSESATPESGPGSEPATSGS ETPGTSESATPESGPGSEPATSGSETPGTSESATPESGPGTSTEPS EGSAPGSPAGSPTSTEEGTSESATPESGPGSEPATSGSETPGTSES ATPESGPGSPAGSPTSTEEGSPAGSPTSTEEGTSTEPSEGSAPGTS ESATPESGPGTSESATPESGPGTSESATPESGPGSEPATSGSETPG SEPATSGSETPGSPAGSPTSTEEGTSTEPSEGSAPGTSTEPSEGSA PGSEPATSGSETPGTSESATPESGPGTSTEPSEGSAPGHHHHHH | 506 |

TABLE 12-continued

Chimeric Polypeptide Assembly Sequences

| Construct ID | Tumor Targets | Amino Acid Sequences | SEQ ID NO: |
|---|---|---|---|
| AC1504 | HER2 | DIQMTQSPSSLSASVGDRVTITCRASQDVNTAVAWYQQKPGKAPKL LIYSASFLYSGVPSRFSGSRSGTDFTLTISSLQPEDFATYYCQQHY TTPPTFGQGTKVEIKGATPPETGAETESPGETTGGSAESEPPGEGE VQLVESGGGLVQPGGSLRLSCAASGFNIKDTYIHWVRQAPGKGLEW VARIYPTNGYTRYADSVKGRFTISADTSKNTAYLQMNSLRAEDTAV YYCSRWGGDGFYAMDYWGQGTLVTVSSGGGGSELVVTQEPSLTVSP GGTVTLTCRSSTGAVTTSNYANWVQQKPGQAPRGLIGGTNKRAPGT PARFSGSLLGGKAALTLSGVQPEDEAEYYCALWYSNLWVFGGGTKL TVLGATPPETGAETESPGETTGGSAESEPPGEGEVQLLESGGGLVQ PGGSLKLSCAASGFTFNTYAMNWVRQAPGKGLEWVARIRSKYNNYA TYYADSVKDRFTISRDDSKNTAYLQMNNLKTEDTAVYYCVRHGNFG NSYVSWFAYWGQGTLVTVSSGSPGSPAGSPTSTEEGTSESATPESG PGTSTEPSEGSAPGSPAGSPTSTEEGTSTEPSEGSAPGTSTEPSEG SAPGTSESATPESGPGSEPATSGSETPGSEPATSGSETPGSPAGSP TSTEEGTSESATPESGPGTSTEPSEGSAPGTSTEPSEGSAPGSPAG SPTSTEEGTSTEPSEGSAPGTSTEPSEGSAPGTSESATPESGPGTS TEPSEGSAPGTSESATPESGPGSEPATSGSETPGTSTEPSEGSAPG TSTEPSEGSAPGTSESATPESGPGTSESATPESGPGSPAGSPTSTE EGTSESATPESGPGSEPATSGSETPGTSESATPESGPGTSTEPSEG SAPGTSTEPSEGSAPGTSTEPSEGSAPGTSTEPSEGSAPGTSTEPS EGSAPGTSTEPSEGSAPGSPAGSPTSTEEGTSTEPSEGSAPGTSES ATPESGPGSEPATSGSETPGTSESATPESGPGSEPATSGSETPGTS ESATPESGPGTSTEPSEGSAPGTSESATPESGPGSPAGSPTSTEEG SPAGSPTSTEEGSPAGSPTSTEEGTSESATPESGPGTSTEPSEGSA PGTSESATPESGPGSEPATSGSETPGTSESATPESGPGSEPATSGS ETPGTSESATPESGPGTSTEPSEGSAPGSPAGSPTSTEEGTSESAT PESGPGSEPATSGSETPGTSESATPESGPGSPAGSPTSTEEGSPAG SPTSTEEGTSTEPSEGSAPGTSESATPESGPGTSESATPESGPGTS ESATPESGPGSEPATSGSETPGSEPATSGSETPGSPAGSPTSTEEG TSTEPSEGSAPGTSTEPSEGSAPGSEPATSGSETPGTSESATPESG PGTSTEPSEGSAPGHHHHHH | 507 |
| AC1505 | HER2 | DIQMTQSPSSLSASVGDRVTITCKASQDVSIGVAWYQQKPGKAPKL LIYSASYRYTGVPSRFSGSGSGTDFTLTISSLQPEDFATYYCQQYY IYPYTFGQGTKVEIKGATPPETGAETESPGETTGGSAESEPPGEGE VQLVESGGGLVQPGGSLRLSCAASGFTFTDYTMDWVRQAPGKGLEW VADVNPNSGGSIYNQRFKGRFTLSVDRSKNTLYLQMNSLRAEDTAV YYCARNLGPSFYFDYWGQGTLVTVSSGGGGSDIQMTQSPSSLSASV GDRVTITCRASQDIRNYLNWYQQKPGKAPKLLIYYTSRLESGVPSR FSGSGSGTDYTLTISSLQPEDFATYYCQQGNTLPWTFGQGTKVEIK GATPPETGAETESPGETTGGSAESEPPGEGEVQLVESGGGLVQPGG SLRLSCAASGYSFTGYTMNWVRQAPGKGLEWVALINPYKGVSTYNQ KFKDRFTISVDKSKNTAYLQMNSLRAEDTAVYYCARSGYYGDSDWY FDVWGQGTLVTVSSGTAEAASASGLSGRSDNHSPLGLAGSPGSPAG SPTSTEEGTSESATPESGPGTSTEPSEGSAPGSPAGSPTSTEEGTS TEPSEGSAPGTSTEPSEGSAPGTSESATPESGPGSEPATSGSETPG SEPATSGSETPGSPAGSPTSTEEGTSESATPESGPGTSTEPSEGSA PGTSTEPSEGSAPGSPAGSPTSTEEGTSTEPSEGSAPGTSTEPSEG SAPGTSESATPESGPGTSTEPSEGSAPGTSESATPESGPGSEPATS GSETPGTSTEPSEGSAPGTSTEPSEGSAPGTSESATPESGPGTSES ATPESGPGSPAGSPTSTEEGTSESATPESGPGSEPATSGSETPGTS ESATPESGPGTSTEPSEGSAPGTSTEPSEGSAPGTSTEPSEGSAPG TSTEPSEGSAPGTSTEPSEGSAPGTSTEPSEGSAPGSPAGSPTSTE EGTSTEPSEGSAPGTSESATPESGPGSEPATSGSETPGTSESATPE SGPGSEPATSGSETPGTSESATPESGPGTSTEPSEGSAPGTSESAT PESGPGSPAGSPTSTEEGSPAGSPTSTEEGSPAGSPTSTEEGTSES ATPESGPGTSTEPSEGSAPGTSESATPESGPGSEPATSGSETPGTS ESATPESGPGSEPATSGSETPGTSESATPESGPGTSTEPSEGSAPG SPAGSPTSTEEGTSESATPESGPGSEPATSGSETPGTSESATPESG PGSPAGSPTSTEEGSPAGSPTSTEEGTSTEPSEGSAPGTSESATPE SGPGTSESATPESGPGSEPATSGSETPGSEPATS GSETPGSPAGSPTSTEEGTSTEPSEGSAPGTSTEPSEGSAPGSEPA TSGSETPGTSESATPESGPGTSTEPSEGSAPGHHHHHH | 508 |
| AC1506 | HER2 | DIQMTQSPSSLSASVGDRVTITCKASQDVSIGVAWYQQKPGKAPKL LIYSASYRYTGVPSRFSGSGSGTDFTLTISSLQPEDFATYYCQQYY IYPYTFGQGTKVEIKGATPPETGAETESPGETTGGSAESEPPGEGE VQLVESGGGLVQPGGSLRLSCAASGFTFTDYTMDWVRQAPGKGLEW VADVNPNSGGSIYNQRFKGRFTLSVDRSKNTLYLQMNSLRAEDTAV YYCARNLGPSFYFDYWGQGTLVTVSSGGGGSDIQMTQSPSSLSASV GDRVTITCRASQDIRNYLNWYQQKPGKAPKLLIYYTSRLESGVPSR FSGSGSGTDYTLTISSLQPEDFATYYCQQGNTLPWTFGQGTKVEIK GATPPETGAETESPGETTGGSAESEPPGEGEVQLVESGGGLVQPGG | 509 |

TABLE 12-continued

Chimeric Polypeptide Assembly Sequences

| Construct ID | Tumor Targets | Amino Acid Sequences | SEQ ID NO: |
|---|---|---|---|
| | | SLRLSCAASGYSFTGYTMNWVRQAPGKGLEWVALINPYKGVSTYNQ KFKDRFTISVDKSKNTAYLQMNSLRAEDTAVYYCARSGYYGDSDWY FDVWGQGTLVTVSSGSPGSPAGSPTSTEEGTSESATPESGPGTSTE PSEGSAPGSPAGSPTSTEEGTSTEPSEGSAPGTSTEPSEGSAPGTS ESATPESGPGSEPATSGSETPGSEPATPGSPAGSPTSTEEG TSESATPESGPGTSTEPSEGSAPGTSTEPSEGSAPGSPAGSPTSTE EGTSTEPSEGSAPGTSTEPSEGSAPGTSESATPESGPGTSTEPSEG SAPGTSESATPESGPGSEPATSGSETPGTSTEPSEGSAPGTSTEPS EGSAPGTSESATPESGPGTSESATPESGPGSPAGSPTSTEEGTSES ATPESGPGSEPATSGSETPGTSESATPESGPGTSTEPSEGSAPGTS TEPSEGSAPGTSTEPSEGSAPGTSTEPSEGSAPGTSTEPSEGSAPG TSTEPSEGSAPGSPAGSPTSTEEGTSTEPSEGSAPGTSESATPESG PGSEPATSGSETPGTSESATPESGPGSEPATSGSETPGTSESATPE SGPGTSTEPSEGSAPGTSESATPESGPGSPAGSPTSTEEGSPAGSP TSTEEGSPAGSPTSTEEGTSESATPESGPGTSTEPSEGSAPGTSES ATPESGPGSEPATSGSETPGTSESATPESGPGSEPATSGSETPGTS ESATPESGPGTSTEPSEGSAPGSPAGSPTSTEEGTSESATPESGPG SEPATSGSETPGTSESATPESGPGSPAGSPTSTEEGSPAGSPTSTE EGTSTEPSEGSAPGTSESATPESGPGTSESATPESGPGTSESATPE SGPGSEPATSGSETPGSEPATSGSETPGSPAGSPTSTEEGTSTEPS EGSAPGTSTEPSEGSAPGSEPATSGSETPGTSESATPESGPGTSTE PSEGSAPGHHHHHH | |

TABLE 13

Sequences of First Portion Binding Domains

| Construct ID | Tumor Targets | Amino Acid Sequences | SEQ ID NO: |
|---|---|---|---|
| AC1277 | CD19 | HHHHHHHHDIQLTQSPASLAVSLGQRATISCKASQSVDYDGDSYL NWYQQIPGQPPKLLIYDASNLVSGIPPRFSGSGSGTDFTLNIHPV EKVDAATYHCQQSTEDPWTFGGGTKLEIKGGGGSGGGGSGGGGSQ VQLQQSGAELVRPGSSVKISCKASGYAFSSYWMNWVKQRPGQGLE WIGQIWPGDGDTNYNGKFKGKATLTADESSSTAYMQLSSLASEDS AVYFCARRETTTVGRYYYAMDYWGQGTTVTVSSGGGGSDIKLQQS GAELARPGASVKMSCKTSGYTFTRYTMHWVKQRPGQGLEWIGYIN PSRGYTNYNQKFKDKATLTTDKSSSTAYMQLSSLTSEDSAVYYCA RYYDDHYCLDYWGQGTTLTVSSVEGGSGGSGGSGGSGGVDDIQLT QSPAIMSASPGEKVTMTCRASSSVSYMNWYQQKSGTSPKRWIYDT SKVASGVPYRFSGSGSGTSYSLTISSMEAEDAATYYCQQWSSNPL TFGAGTKLELKGTAEAASASGLSRSDNHSPLG | 510 |
| AC1278 | EpCAM | HHHHHHHHELVMTQSPSSLTVTAGEKVTMSCKSSQSLLNSGNQKN YLTWYQQKPGQPPKLLIYWASTRESGVPDRFTGSGSGTDFTLTIS SVQAEDLAVYYCQNDYSYPLTFGAGTKLEIKGGGGSGGGGSGGGG SEVQLLEQSGAELVRPGTSVKISCKASGYAFTNYWLGWVKQRPGH GLEWIGDIFPGSGNIHYNEKFKGKATLTADKSSSTAYMQLSSLTF EDSAVYFCARLRNWDEPMDYWGQGTTVTVSSGGGGSDVQLVQSGA EVKKPGASVKVSCKASGYTFTRYTMHWVRQAPGQGLEWIGYINPS RGYTNYADSVKGRFTITTDKSTSTAYMELSSLRSEDTATYYCARY YDDHYCLDYWGQGTTVTVSSGEGTSTGSGGSGGSGGADDIVLTQS PATLSLSPGERATLSCRASQSVSYMNWYQQKPGKAPKRWIYDTSK VASGVPARFSGSGSGTDYSLTINSLEAEDAATYYCQQWSSNPLTF GGGTKVEIKGTAEAASASGLSRSDNHSPLG | 511 |
| AC1345 | EpCAM | HHHHHHHHEVQLLEQSGAELVRPGTSVKISCKASGYAFTNYWLGW VKQRPGHGLEWIGDIFPGSGNIHYNEKFKGKATLTADKSSSTAYM QLSSLTFEDSAVYFCARLRNWDEPMDYWGQGTTVTVSSGGGGSDV QLVQSGAEVKKPGASVKVSCKASGYTFTRYTMHWVRQAPGQGLEW IGYINPSRGYTNYADSVKGRFTITTDKSTSTAYMELSSLRSEDTA TYYCARYYDDHYCLDYWGQGTTVTVSSGEGTSTGSGGSGGSGGAD DIVLTQSPATLSLSPGERATLSCRASQSVSYMNWYQQKPGKAPKR WIYDTSKVASGVPARFSGSGSGTDYSLTINSLEAEDAATYYCQQW SSNPLTFGGGTKVEIKGGGGSELVMTQSPSSLTVTAGEKVTMSCK SSQSLLNSGNQKNYLTWYQQKPGQPPKLLIYWASTRESGVPDRFT GSGSGTDFTLTISSVQAEDLAVYYCQNDYSYPLTFGAGTKLEIKG TAEAASASGLSRSDNHSPLG | 512 |

TABLE 13-continued

Sequences of First Portion Binding Domains

| Construct ID | Tumor Targets | Amino Acid Sequences | SEQ ID NO: |
|---|---|---|---|
| AC1346 | EpCAM | HHHHHHHHDVQLVQSGAEVKKPGASVKVSCKASGYTFTRYTMHWV RQAPGQGLEWIGYINPSRGYTNYADSVKGRFTITTDKSTSTAYME LSSLRSEDTATYYCARYYDDHYCLDYWGQGTTVTVSSGGSELVMT QSPSSLTVTAGEKVTMSCKSSQSLLNSGNQKNYLTWYQQKPGQPP KLLIYWASTRESGVPDRFTGSGSGTDFTLTISSVQAEDLAVYYCQ NDYSYPLTFGAGTKLEIKGGGGSGGGGSGGGGSEVQLLEQSGAEL VRPGTSVKISCKASGYAFTNYWLGWVKQRPGHGLEWIGDIFPGSG NIHYNEKFKGKATLTADKSSSTAYMQLSSLTFEDSAVYFCARLRN WDEPMDYWGQGTTVTVSSGGGSDIVLTQSPATLSLSPGERATLSC RASQSVSYMNWYQQKPGKAPKRWIYDTSKVASGVPARFSGSGSGT DYSLTINSLEAEDAATYYCQQWSSNPLTFGGGTKVEIKGTAEAAS ASGLSGRSDNHSPLG | 513 |
| AC1358 | EpCAM | HHHHHHHHELVMTQSPSSLTVTAGEKVTMSCKSSQSLLNSGNQKN YLTWYQQKPGQPPKLLIYWASTRESGVPDRFTGSGSGTDFTLTIS SVQAEDLAVYYCQNDYSYPLTFGAGTKLEIKGGGGSGGGGSGGGG SEVQLLEQSGAELVRPGTSVKISCKASGYAFTNYWLGWVKQRPGH GLEWIGDIFPGSGNIHYNEKFKGKATLTADKSSSTAYMQLSSLTF EDSAVYFCARLRNWDEPMDYWGQGTTVTVSSGGGGSDIQMTQSPS SLSASVGDRVTITCRASQDIRNYLNWYQQKPGKAPKLLIYYTSRL ESGVPSRFSGSGSGTDYTLTISSLQPEDFATYYCQQGNTLPWTFG QGTKVEIKRTSGPDGDGGKGGPGKGPGGEGTKGTGPGGEVQLVESG GGLVQPGGSLRLSCAASGYSFTGYTMNWVRQAPGKGLEWVALINP YKGVSTYNQKFKDRFTISVDKSKNTAYLQMNSLRAEDTAVYYCAR SGYYGDSDWYFDVWGQGTLVTVSSGTAEAASASGLSGRSDNHSPL G | 514 |
| AC1359 | EpCAM | HHHHHHHHELVMTQSPSSLTVTAGEKVTMSCKSSQSLLNSGNQKN YLTWYQQKPGQPPKLLIYWASTRESGVPDRFTGSGSGTDFTLTIS SVQAEDLAVYYCQNDYSYPLTFGAGTKLEIKGGGGSGGGGSGGGG SEVQLLEQSGAELVRPGTSVKISCKASGYAFTNYWLGWVKQRPGH GLEWIGDIFPGSGNIHYNEKFKGKATLTADKSSSTAYMQLSSLTF EDSAVYFCARLRNWDEPMDYWGQGTTVTVSSGGGGSEVQLVESGG GLVQPGGSLRLSCAASGYSFTGYTMNWVRQAPGKGLEWVALINPY KGVSTYNQKFKDRFTISVDKSKNTAYLQMNSLRAEDTAVYYCARS GYYGDSDWYFDVWGQGTLVTVSSRTSGPDGDGGKGGPGKGPGGEGT KGTGPGGDIQMTQSPSSLSASVGDRVTITCRASQDIRNYLNWYQQ KPGKAPKLLIYYTSRLESGVPSRFSGSGSGTDYTLTISSLQPEDF ATYYCQQGNTLPWTFGQGTKVEIKGTAEAASASGLSGRSDNHSPL G | 515 |
| AC1409 | EpCAM | LAGSGTAEAASASGELVMTQSPSSLTVTAGEKVTMSCKSSQSLLN SGNQKNYLTWYQQKPGQPPKLLIYWASTRESGVPDRFTGSGSGTD FTLTISSVQAEDLAVYYCQNDYSYPLTFGAGTKLEIKGGGGSGGG GSGGGGSEVQLLEQSGAELVRPGTSVKISCKASGYAFTNYWLGWV KQRPGHGLEWIGDIFPGSGNIHYNEKFKGKATLTADKSSSTAYMQ LSSLTFEDSAVYFCARLRNWDEPMDYWGQGTTVTVSSGGGGSDVQ LVQSGAEVKKPGASVKVSCKASGYTFTRYTMHWVRQAPGQGLEWI GYINPSRGYTNYADSVKGRFTITTDKSTSTAYMELSSLRSEDTAT YYCARYYDDHYCLDYWGQGTTVTVSSGEGTSTGSGGSGGSGGADD IVLTQSPATLSLSPGERATLSCRASQSVSYMNWYQQKPGKAPKRW IYDTSKVASGVPARFSGSGSGTDYSLTINSLEAEDAATYYCQQWS SNPLTFGGGTKVEIKGTAEAASASGLSGRSDNHSPLG | 516 |
| AC1410 | EpCAM | LAGSGTAEAASASGELVMTQSPSSLTVTAGEKVTMSCKSSQSLLN SGNQKNYLTWYQQKPGQPPKLLIYWASTRESGVPDRFTGSGSGTD FTLTISSVQAEDLAVYYCQNDYSYPLTFGAGTKLEIKGGGGSGGG GSGGGGSEVQLLEQSGAELVRPGTSVKISCKASGYAFTNYWLGWV KQRPGHGLEWIGDIFPGSGNIHYNEKFKGKATLTADKSSSTAYMQ LSSLTFEDSAVYFCARLRNWDEPMDYWGQGTTVTVSSGGGGSDVQ LVQSGAEVKKPGASVKVSCKASGYTFTRYTMHWVRQAPGQGLEWI GYINPSRGYTNYADSVKGRFTITTDKSTSTAYMELSSLRSEDTAT YYCARYYDDHYCLDYWGQGTTVTVSSGEGTSTGSGGSGGSGGADD IVLTQSPATLSLSPGERATLSCRASQSVSYMNWYQQKPGKAPKRW IYDTSKVASGVPARFSGSGSGTDYSLTINSLEAEDAATYYCQQWS SNPLTFGGGTKVEIKHHHHHHHH | 517 |
| AC1411 | EpCAM | HHHHHHHHELVMTQSPSSLTVTAGEKVTMSCKSSQSLLNSGNQKN YLTWYQQKPGQPPKLLIYWASTRESGVPDRFTGSGSGTDFTLTIS SVQAEDLAVYYCQNDYSYPLTFGAGTKLEIKGGGGSGGGGSGGGG SEVQLLEQSGAELVRPGTSVKISCKASGYAFTNYWLGWVKQRPGH GLEWIGDIFPGSGNIHYNEKFKGKATLTADKSSSTAYMQLSSLTF EDSAVYFCARLRNWDEPMDYWGQGTTVTVSSGGGGSDIVLTQSPA | 518 |

TABLE 13-continued

Sequences of First Portion Binding Domains

| Construct ID | Tumor Targets | Amino Acid Sequences | SEQ ID NO: |
|---|---|---|---|
| | | TLSLSPGERATLSCRASQSVSYMNWYQQKPGKAPKRWIYDTSKVA SGVPARFSGSGSGTDYSLTINSLEAEDAATYYCQQWSSNPLTFGG GTKVEIKGEGTSTGSGGSGGSGGADDVQLVQSGAEVKKPGASVKV SCKASGYTFTRYTMHWVRQAPGQGLEWIGYINPSRGYTNYADSVK GRFTITTDKSTSTAYMELSSLRSEDTATYYCARYYDDHYCLDYWG QGTTVTVSSGTAEAASASGLSGRSDNHSPLG | |
| AC1412 | EpCAM | HHHHHHHHEVQLLEQSGAELVRPGTSVKISCKASGYAFTNYWLGW VKQRPGHGLEWIGDIFPGSGNIHYNEKFKGKATLTADKSSSTAYM QLSSLTFEDSAVYFCARLRNWDEPMDYWGQGTTVTVSSGGGGSGG GGSGGGGSELVMTQSPSSLTVTAGEKVTMSCKSSQSLLNSGNQKN YLTWYQQKPGQPPKLLIYWASTRESGVPDRFTGSGSGTDFTLTIS SVQAEDLAVYYCQNDYSYPLTFGAGTKLEIKGGGGSDVQLVQSGA EVKKPGASVKVSCKASGYTFTRYTMHWVRQAPGQGLEWIGYINPS RGYTNYADSVKGRFTITTDKSTSTAYMELSSLRSEDTATYYCARY YDDHYCLDYWGQGTTVTVSSGEGTSTGSGGSGGSGGADDIVLTQS PATLSLSPGERATLSCRASQSVSYMNWYQQKPGKAPKRWIYDTSK VASGVPARFSGSGSGTDYSLTINSLEAEDAATYYCQQWSSNPLTF GGGTKVEIKGTAEAASASGLSGRSDNHSPLG | 519 |
| AC1413 | EpCAM | HHHHHHHHDVQLVQSGAEVKKPGASVKVSCKASGYTFTRYTMHWV RQAPGQGLEWIGYINPSRGYTNYADSVKGRFTITTDKSTSTAYME LSSLRSEDTATYYCARYYDDHYCLDYWGQGTTVTVSSGEGTSTGS GGSGGSGGADDIVLTQSPATLSLSPGERATLSCRASQSVSYMNWY QQKPGKAPKRWIYDTSKVASGVPARFSGSGSGTDYSLTINSLEAE DAATYYCQQWSSNPLTFGGGTKVEIKGGGGSELVMTQSPSSLTVT AGEKVTMSCKSSQSLLNSGNQKNYLTWYQQKPGQPPKLLIYWAST RESGVPDRFTGSGSGTDFTLTISSVQAEDLAVYYCQNDYSYPLTF GAGTKLEIKGGGGSGGGGSGGGGSEVQLLEQSGAELVRPGTSVKI SCKASGYAFTNYWLGWVKQRPGHGLEWIGDIFPGSGNIHYNEKFK GKATLTADKSSSTAYMQLSSLTFEDSAVYFCARLRNWDEPMDYWG QGTTVTVSSGTAEAASASGLSGRSDNHSPLG | 520 |
| AC1414 | EpCAM | HHHHHHHHDIVLTQSPATLSLSPGERATLSCRASQSVSYMNWYQQ KPGKAPKRWIYDTSKVASGVPARFSGSGSGTDYSLTINSLEAEDA ATYYCQQWSSNPLTFGGGTKVEIKGEGTSTGSGGSGGSGGADDVQ LVQSGAEVKKPGASVKVSCKASGYTFTRYTMHWVRQAPGQGLEWI GYINPSRGYTNYADSVKGRFTITTDKSTSTAYMELSSLRSEDTAT YYCARYYDDHYCLDYWGQGTTVTVSSGGGGSELVMTQSPSSLTVT AGEKVTMSCKSSQSLLNSGNQKNYLTWYQQKPGQPPKLLIYWAST RESGVPDRFTGSGSGTDFTLTISSVQAEDLAVYYCQNDYSYPLTF GAGTKLEIKGGGGSGGGGSGGGGSEVQLLEQSGAELVRPGTSVKI SCKASGYAFTNYWLGWVKQRPGHGLEWIGDIFPGSGNIHYNEKFK GKATLTADKSSSTAYMQLSSLTFEDSAVYFCARLRNWDEPMDYWG QGTTVTVSSGTAEAASASGLSGRSDNHSPLG | 521 |
| AC1476 | EpCAM | DIQMTQSPSSLSASVGDRVTITCRSTKSLLHSNGITYLYWYQQKP GKAPKLLIYQMSNLASGVPSRFSSSGSGTDFTLTISSLQPEDFAT YYCAQNLEIPRTFGQGTKVEIKGATPPETGAETESPGETTGGSAE SEPPGEGQVQLVQSGPGLVQPGGSVRISCAASGYTFTNYGMNWVK QAPGKGLEWMGWINTYTGESTYADSFKGRFTFSLDTSASAAYLQI NSLRAEDTAVYYCARFAIKGDYWGQGTLLTVSSGGGGSDIQMTQS PSSLSASVGDRVTITCRASQDIRNYLNWYQQKPGKAPKLLIYYTS RLESGVPSRFSGSGSGTDYTLTISSLQPEDFATYYCQQGNTLPWT FGQGTKVEIKGATPPETGAETESPGETTGGSAESEPPGEGEVQLV ESGGGLVQPGGSLRLSCAASGYSFTGYTMNWVRQAPGKGLEWVAL INPYKGVSTYNQKFKDRFTISVDKSKNTAYLQMNSLRAEDTAVYY CARSGYYGDSDWYFDVWGQGTLVTVSSGTAEAASASGLSGRSDNH SPLG | 522 |
| AC1489 | EpCAM | DIVMTQSPLSLPVTPGEPASISCRSSKNLLHSNGITYLYWYLQKP GQSPQLLIYQMSNLASGVPDRFSSSGSGTDFTLKISRVEAEDVGV YYCAQNLEIPRTFGQGTKVEIKGATPPETGAETESPGETTGGSAE SEPPGEGQVQLVQSGPEVKKPGASVKVSCKASGYTFTNYGMNWVR QAPGQGLEWMGWINTYTGEPTYGEDFKGRFAFSLDTSASTAYMEL SSLRSEDTAVYFCARFGNYVDYWGQGSLVTVSSGGGGSELVVTQE PSLTVSPGGTVTLTCRSSTGAVTTSNYANWVQQKPGQAPRGLIGG TNKRAPGTPARFSGSLLGGKAALTLSGVQPEDEAEYYCALWYSNL WVFGGGTKLTVLGATPPETGAETESPGETTGGSAESEPPGEGEVQ LLESGGGLVQPGGSLKLSCAASGFTFNTYAMNWVRQAPGKGLEWV ARIRSKYNNYATYYADSVKDRFTISRDDSKNTAYLQMNNLKTEDT AVYYCVRHGNFGNSYVSWFAYWGQGTLVTVSSGTAEAASASGLSG RSDNHSPLG | 523 |

TABLE 13-continued

Sequences of First Portion Binding Domains

| Construct ID | Tumor Targets | Amino Acid Sequences | SEQ ID NO: |
|---|---|---|---|
| AC1507 | EpCAM | LAGSGTAEAASASGDIQMTQSPSSLSASVGDRVTITCRASQDIRN YLNWYQQKPGKAPKLLIYYTSRLESGVPSRFSGSGSGTDYTLTIS SLQPEDFATYYCQQGNTLPWTFGQGTKVEIKGATPPETGAETESP GETTGGSAESEPPGEGEVQLVESGGGLVQPGGSLRLSCAASGYSF TGYTMNWVRQAPGKGLEWVALINPYKGVSTYNQKFKDRFTISVDK SKNTAYLQMNSLRAEDTAVYYCARSGYYGDSDWYFDVWGQGTLVT VSSGGGGSDIQMTQSPSSLSASVGDRVTITCRSTKSLLHSNGITY LYWYQQKPGKAPKLLIYQMSNLASGVPSRFSSSGSGTDFTLTISS LQPEDFATYYCAQNLEIPRTFGQGTKVEIKGATPPETGAETESPG ETTGGSAESEPPGEGQVQLVQSGPGLVQPGGSVRISCAASGYTFT NYGMNWVKQAPGKGLEWMGWINTYTGESTYADSFKGRFTFSLDTS ASAAYLQINSLRAEDTAVYYCARFAIKGDYWGQGTLLTVSS | 524 |
| AC1501 | HER2 | DIQMTQSPSSLSASVGDRVTITCRASQDVNTAVAWYQQKPGKAPK LLIYSASFLYSGVPSRFSGSRSGTDFTLTISSLQPEDFATYYCQQ HYTTPPTFGQGTKVEIKGATPPETGAETESPGETTGGSAESEPPG EGEVQLVESGGGLVQPGGSLRLSCAASGFNIKDTYIHWVRQAPGK GLEWVARIYPTNGYTRYADSVKGRFTISADTSKNTAYLQMNSLRA EDTAVYYCSRWGDGFYAMDYWGQGTLVTVSSGGGGSDIQMTQSP SSLSASVGDRVTITCRASQDIRNYLNWYQQKPGKAPKLLIYYTSR LESGVPSRFSGSGSGTDYTLTISSLQPEDFATYYCQQGNTLPWTF GQGTKVEIKGATPPETGAETESPGETTGGSAESEPPGEGEVQLVE SGGGLVQPGGSLRLSCAASGYSFTGYTMNWVRQAPGKGLEWVALI NPYKGVSTYNQKFKDRFTISVDKSKNTAYLQMNSLRAEDTAVYYC ARSGYYGDSDWYFDVWGQGTLVTVSSGTAEAASASGLSGRSDNHS PLG | 525 |
| AC1503 | HER2 | DIQMTQSPSSLSASVGDRVTITCRASQDVNTAVAWYQQKPGKAPK LLIYSASFLYSGVPSRFSGSRSGTDFTLTISSLQPEDFATYYCQQ HYTTPPTFGQGTKVEIKGATPPETGAETESPGETTGGSAESEPPG EGEVQLVESGGGLVQPGGSLRLSCAASGFNIKDTYIHWVRQAPGK GLEWVARIYPTNGYTRYADSVKGRFTISADTSKNTAYLQMNSLRA EDTAVYYCSRWGDGFYAMDYWGQGTLVTVSSGGGGSELVVTQEP SLTVSPGGTVTLTCRSSTGAVTTSNYANWVQQKPGQAPRGLIGGT NKRAPGTPARFSGSLLGGKAALTLSGVQPEDEAEYYCALWYSNLW VFGGGTKLTVLGATPPETGAETESPGETTGGSAESEPPGEGEVQL LESGGGLVQPGGSLKLSCAASGFTFNTYAMNWVRQAPGKGLEWVA RIRSKYNNYATYYADSVKDRFTISRDDSKNTAYLQMNNLKTEDTA VYYCVRHGNFGNSYVSWFAYWGQGTLVTVSSGTAEAASASGLSGR SDNHSPLG | 526 |
| AC1505 | HER2 | DIQMTQSPSSLSASVGDRVTITCKASQDVSIGVAWYQQKPGKAPK LLIYSASYRYTGVPSRFSGSGSGTDFTLTISSLQPEDFATYYCQQ YYIYPYTFGQGTKVEIKGATPPETGAETESPGETTGGSAESEPPG EGEVQLVESGGGLVQPGGSLRLSCAASGFTFTDYTMDWVRQAPGK GLEWVADVNPNSGGSIYNQRFKGRFTLSVDRSKNTLYLQMNSLRA EDTAVYYCARNLGPSFYFDYWGQGTLVTVSSGGGGSDIQMTQSPS SLSASVGDRVTITCRASQDIRNYLNWYQQKPGKAPKLLIYYTSRL ESGVPSRFSGSGSGTDYTLTISSLQPEDFATYYCQQGNTLPWTFG QGTKVEIKGATPPETGAETESPGETTGGSAESEPPGEGEVQLVES GGGLVQPGGSLRLSCAASGYSFTGYTMNWVRQAPGKGLEWVALIN PYKGVSTYNQKFKDRFTISVDKSKNTAYLQMNSLRAEDTAVYYCA RSGYYGDSDWYFDVWGQGTLVTVSSGTAEAASASGLSGRSDNHSP LG | 527 |
| AC1518 | HER2 | DIQMTQSPSSLSASVGDRVTITCKASQDVSIGVAWYQQKPGKAPK LLIYSASYRYTGVPSRFSGSGSGTDFTLTISSLQPEDFATYYCQQ YYIYPYTFGQGTKVEIKGATPPETGAETESPGETTGGSAESEPPG EGEVQLVESGGGLVQPGGSLRLSCAASGFTFTDYTMDWVRQAPGK GLEWVADVNPNSGGSIYNQRFKGRFTLSVDRSKNTLYLQMNSLRA EDTAVYYCARNLGPSFYFDYWGQGTLVTVSSGGGGSELVVTQEPS LTVSPGGTVTLTCRSSTGAVTTSNYANWVQQKPGQAPRGLIGGTN KRAPGTPARFSGSLLGGKAALTLSGVQPEDEAEYYCALWYSNLWV FGGGTKLTVLGATPPETGAETESPGETTGGSAESEPPGEGEVQLL ESGGGLVQPGGSLKLSCAASGFTFNTYAMNWVRQAPGKGLEWVAR IRSKYNNYATYYADSVKDRFTISRDDSKNTAYLQMNNLKTEDTAV YYCVRHGNFGNSYVSWFAYWGQGTLVTVSSGTAEAASASGLSGRS DNHSPLG | 528 |
| AC1521 | CEA | DIQLTQSPSSLSASVGDRVTITCKASQDVGTSVAWYQQKPGKAPK LLIYWTSTRHTGVPSRFSGSGSGTDFTFTISSLQPEDIATYYCQQ YSLYRSFGQGTKVEIKGATPPETGAETESPGETTGGSAESEPPGE GEVQLVESGGGVVQPGRSLRLSCSASGFDFTTYWMSWVRQAPGKG LEWIGEIHPDSSTINYAPSLKDRFTISRDNAKNTLFLQMDSLRPE | 529 |

TABLE 13-continued

Sequences of First Portion Binding Domains

| Construct ID | Tumor Targets | Amino Acid Sequences | SEQ ID NO: |
|---|---|---|---|
| | | DTGVYFCASLYFGFPWFAYWGQGTPVTVSSGGGGSDIQMTQSPSS LSASVGDRVTITCRASQDIRNYLNWYQQKPGKAPKLLIYYTSRLE SGVPSRFSGSGSGTDYTLTISSLQPEDFATYYCQQGNTLPWTFGQ GTKVEIKGATPPETGAETESPGETTGGSAESEPPGEGEVQLVESG GGLVQPGGSLRLSCAASGYSFTGYTMNWVRQAPGKGLEWVALINP YKGVSTYNQKFKDRFTISVDKSKNTAYLQMNSLRAEDTAVYYCAR SGYYGDSDWYFDVWGQGTLVTVSSGTAEAASASGLSGRSDNHSPL G | |
| AC1522 | PSMA | DIQMTQSPSSLSTSVGDRVTLTCKASQDVGTAVDWYQQKPGPSPK LLIYWASTRHTGIPSRFSGSGSGTDFTLTISSLQPEDFADYYCQQ YNSYPLTFGPGTKVDIKGATPPETGAETESPGETTGGSAESEPPG EGEVQLVQSGPEVKKPGATVKISCKTSGYTFTEYTIHWVKQAPGK GLEWIGNINPNNGGTTYNQKFEDKATLTVDKSTDTAYMELSSLRS EDTAVYYCAAGWNFDYWGQGTLLTVSSGGGGSDIQMTQSPSSLSA SVGDRVTITCRASQDIRNYLNWYQQKPGKAPKLLIYYTSRLESGV PSRFSGSGSGTDYTLTISSLQPEDFATYYCQQGNTLPWTFGQGTK VEIKGATPPETGAETESPGETTGGSAESEPPGEGEVQLVESGGGL VQPGGSLRLSCAASGYSFTGYTMNWVRQAPGKGLEWVALINPYKG VSTYNQKFKDRFTISVDKSKNTAYLQMNSLRAEDTAVYYCARSGY YGDSDWYFDVWGQGTLVTVSSGTAEAASASGLSGRSDNHSPLG | 530 |

TABLE 14

Chimeric Polypeptide Assembly Encoding-construct Sequences

| Construct ID | Tumor Targets | DNA Sequences | SEQ ID NO: |
|---|---|---|---|
| AC1476 | EpCAM | gatattcagatgacccaatcgccgtcgtccctgtcagcttcagtc ggtgatcgtgttaccattacctgtcgctcaacgaaatccctgctg cattcaaacggtattacctatctgtactggtatcagcaaaaaccg ggcaaagcgccgaaactgctgatctaccagatgtcgaatctggcc agcggtgttccgtctcgttttagctctagtggttctggcaccgat ttcaccctgacgatttcctcactgcaaccggaagactttgcaacg tattactgcgctcagaacctggaaatcccgcgtaccttcggtcaa ggcacgaaagtcgaaattaaaGGTGCAACGCCTCCGGAGACTGGT GCTGAAACTGAGTCCCCGGGCGAGACGACCGGTGGCTCTGCTGAA TCCGAACCACCGGGCGAAGGCcaagtgcaactggttcagagcggt ccgggtctggtccaaccgggtggcagtgtgcgtatttcctgcgcg gcctcaggttacaccctttacgaactatggcatgaatttgggtgaaa caggccccgggtaaaggcctggaatggatgggttggatcaacacc tacacgggcgaatctacctatgcagatagtttcaaaggccgcttt accttcagcctggacacgtctgctagtgcagcttatctgcagatt aatagcctgcgtgcggaagatacggccgtttattactgtgcgcgc tttgcaatcaaaggcgactactggggccaaggcaccctgctgacc gtgtcctccGGTGGTGGCGGCAGCGACATCCAAATGACCCAGAGC CCGAGCAGCCTGAGCGCGAGCGTGGGCGACCGTGTTACCATCACC TGCCGTGCGAGCCAAGACATCCGTAACTACCTGAACTGGTATCAG CAAAAGCCGGGTAAAGCGCCGAAGCTGCTGATCTACTATACCAGC CGTCTGGAGAGCGGCGTGCCGAGCCGTTTCAGCGGTAGCGGTAGC GGTACCGACTACACCCTGACCATTAGCAGCCTGCAGCCGGAAGAT TTCGCGACCTACTATTGCCAGCAGGGTAACACCCTGCCGTGGACC TTTGGTCAAGGCACCAAAGTTGAGATTAAAGGCGCCACGCCTCCG GAAACTGGTGCTGAGACGGAATCCCCTGGTGAAACCACTGGCGGT TCTGCCGAATCTGAACCGCCTGGTGAAGGCGAGGTGCAGCTGGTT GAAAGCGGTGGCGGTCTGGTGCAACCAGGCGGTAGCCTGCGTCTG AGCTGCGCGGCGAGCGGTTACAGCTTTACCGGTTATACCATGAAC TGGGTTCGTCAAGCGCCAGGTAAAGGTCTGGAGTGGGTGGCGCTG ATCAACCCGTACAAGGGTGTTAGCACCTATAACCAGAAGTTCAAA GACCGTTTTACCATTAGCGTGGATAAGAGCAAAAACACCGCGTAC CTGCAAATGAACAGCCTGCGTGCGGAGGACACCGCTGTGTACTAT TGCGCGCGTAGCGGTTACTATGGCGACAGCGACTGGTATTTTGAT GTGTGGGGCCAAGGCACCCTGGTTACCGTGAGCTCCGGCACCGCC GAAGCAGCTagcgcctctGGCctgTCAggtCGTtctGAtaacCAT tccCCActgGGTctgGCTGGGTCTCCAGGTAGCCCAGCTGGTAGC CCAACCTCTACCGAAGAAGGTACCTCTGAATCCGCTACTCCAGAA TCCGGTCCTGGTACTAGCACTGAGCCAAGCGAAGGTTCTGCTCCA GGCTCCCCGGCAGGTAGCCCTACCTCTACCGAAGAGGGCACTAGC ACCGAACCATCTGAGGGTTCCGCTCCTGGCACCTCCACTGAACCG | 531 |

TABLE 14-continued

Chimeric Polypeptide Assembly Encoding-construct Sequences

| Construct ID | Tumor Targets | DNA Sequences | SEQ ID NO: |
|---|---|---|---|
| | | TCCGAAGGCAGTGCTCCGGGTACTTCCGAAAGCGCAACTCCGGAA<br>TCCGGCCCTGGTTCTGAGCCTGCTACTTCCGGCTCTGAAACTCCA<br>GGTAGCGAGCCAGCGACTTCTGGTTCTGAAACTCCAGGTTCACCG<br>GCGGGTAGCCCGACGAGCACGGAGGAAGGTACCTCTGAGTCGGCC<br>ACTCCTGAGTCCGGTCCGGGCACGAGCACCGAGCCGAGCGAGGGT<br>TCAGCCCCGGGTACCAGCACGGAGCCGTCCGAGGGTAGCGCACCG<br>GGTTCTCCGGCGGGCTCCCCTACGTCTACGGAAGAGGGTACGTCC<br>ACTGAACCTAGCGAGGGCAGCGCGCCAGGCACCAGCACTGAACCG<br>AGCGAAGGCAGCGCACCTGGCACTAGCGAGTCTGCGACTCCGGAG<br>AGCGGTCCGGGTACGAGCACGGAACCAAGCGAAGGCAGCGCCCCA<br>GGTACCTCTGAATCTGCTACCCCAGAATCTGGCCCGGGTTCCGAG<br>CCAGCTACCTCTGGTTCTGAAACCCCAGGTACTTCCACTGAACCA<br>AGCGAAGGTAGCGCTCCTGGCACTTCTACTGAACCATCCGAAGGT<br>TCCGCTCCTGGTACGTCTGAAAGCGCTACCCCTGAAAGCGGCCCA<br>GGCACCTCTGAAAGCGCTACTCCTGAGAGCGGTCCAGGCTCTCCA<br>GCAGGTTCTCCAACCTCCACTGAAGAAGGCACCTCTGAGTCTGCT<br>ACCCCTGAATCTGGTCCTGGCTCCGAACCTGCTACCTCTGGTTCC<br>GAAACTCCAGGTACCTCGGAATCTGCGACTCCGGAATCTGGCCCG<br>GGCACGAGCACGGAGCCGTCTGAGGGTAGCGCACCAGGTACCAGC<br>ACTGAGCCTTCTGAGGGCTCTGCACCGGGTACCTCCACGGAACCT<br>TCGGAAGGTTCTGCGCCGGGTACCTCCACTGAGCCATCCGAGGGT<br>TCAGCACCAGGTACTAGCACGGAACCGTCCGAGGGCTCTGCACCA<br>GGTACGAGCACCGAACCGTCGGAGGGTAGCGCTCCAGGTAGCCCA<br>GCGGGCTCTCCGACAAGCACCGAAGAAGGCACCAGCACCGAGCCG<br>TCCGAAGGTTCCGCACCAGGTACAAGCGAGAGCGCGACTCCTGAA<br>TCTGGTCCGGGTAGCGAGCCTGCAACCAGCGGTTCTGAGACGCCG<br>GGCACTTCCGAATCTGCGACCCCGGAGTCCGGTCCAGGTTCAGAG<br>CCGGCGACGAGCGGTTCGGAAACGCGGGTACGTCTGAATCAGCC<br>ACGCCGGAGTCTGGTCCGGGTACCTCGACCGAACCAAGCGAAGGT<br>TCGGCACCGGGTACTAGCGAGAGCGCAACCCCTGAAAGCGGTCCG<br>GGCAGCCCGGCAGGTTCTCCAACCAGCACCGAAGAAGGTTCCCCT<br>GCTGGTAGCCCGACCTCTACGGAGGAAGGTAGCCCTGCAGGTTCC<br>CCAACTTCTACTGAGGAAGGTACTTCTGAGTCCGCTACCCCAGAA<br>AGCGGTCCTGGTACCTCCACTGAACCGTCTGAAGGCTCTGCACCA<br>GGCACTTCTGAGTCTGCTACTCCAGAAAGCGGCCCAGGTTCTGAA<br>CCAGCAACTTCTGGCTCTGAGACTCCAGGCACTTCTGAGTCCGCA<br>ACGCCTGAATCCGGTCCTGGTTCTGAACCAGCTACTTCCGGCAGC<br>GAAACCCCAGGTACCTCTGAGTCTGCGACTCCAGAGTCTGGTCCT<br>GGTACTTCCACTGAGCCTAGCGAGGGTTCCGCACCAGGTTCTCCG<br>GCTGGTAGCCCGACCAGCACGGAGGAGGGTACGTCTGAATCTGCA<br>ACGCCGGAATCGGGCCCAGGTTCGGAGCCTGCAACGTCTGGCAGC<br>GAAACCCCGGGTACCTCCGAATCTGCTACACCGGAAAGCGGTCCT<br>GGCAGCCCTGCTGGTTCTCCAACCTCTACCGAGGAGGGTTCACCG<br>GCAGGTAGCCCGACTAGCACTGAAGAAGGTACTAGCACGGAGCCG<br>AGCGAGGGTAGTGCTCCGGGTACGAGCGAGAGCGCAACGCCAGAG<br>AGCGGTCCAGGCACCAGCGAATCGGCCACCCCTGAGAGCGGCCCA<br>GGTACTTCTGAGAGCGCCACTCCTGAATCCGGCCCTGGTAGCGAG<br>CCGGCAACCTCCGGCTCAGAAACTCCTGGTTCGGAACCAGCGACC<br>AGCGGTTCTGAAACTCCGGGTAGCCCGGCAGGCAGCCCAACGAGC<br>ACCGAAGAGGGTACCAGCACGGAACCGAGCGAGGGTTCTGCCCCG<br>GGTACTTCCACCGAACCATCGGAGGGCTCTGCACCTGGTAGCGAA<br>CCTGCGACGTCTGGTTCTGAAACGCCGGGTACCAGCGAAAGCGCT<br>ACCCCAGAATCCGGTCCGGGCACTAGCACCGAGCCATCGGAGGGC<br>TCCGCACCAGGTCACCATCATCACCATCAC | |
| AC1516<br>(codon optimized by DNA2.0) | EpCAM | GATATCCAGATGACCCAGAGCCCTTCTTCCCTGTCCGCATCCGTC<br>GGCGATCGTGTCACGATTACCTGTCGCAGCACTAAGAGCCTGCTG<br>CACTCAAACGGTATCACGTACCTGTACTGGTACCAGCAGAAGCCG<br>GGCAAAGCGCCGAAGCTGCTGATTTATCAGATGAGCAACCTGGCA<br>TCGGGCGTGCCGAGCCGTTTCAGCAGCAGCGGTAGCGGTACCGAC<br>TTCACGCTGACCATCAGCTCGTTGCAGCCAGAGGACTTTGCGACG<br>TACTATTGTGCGCAAAACTTGGAAATTCCGCGCACCTTCGGCCAG<br>GGTACGAAAGTTGAGATTAAAGGTGCCACCCCACCGGAGACTGGT<br>GCAGAAACCGAGTCTCCGGGCGAAACCACGGGCGGTAGCGCGGAG<br>AGCGAACCGCTGGTGAGGGTCAAGTTCAATTGGTTCAGAGCGGT<br>CCGGGTCTGGTTCAACCGGGCGGCAGCGTGCGCATTTCTTGTGCG<br>GCCAGCGGTTACACCTTTACGAACTACGGTATGAATTGGGTGAAA<br>CAAGCTCCGGGCAAAGGTCTGGAGTGGATGGGTTGGATCAATACC<br>TATACCGGTGAATCCACTTACGCGGATTCCTTTAAGGGCGTTTC<br>ACCTTCAGCCTGGACACGAGCGCGAGCGCTGCATATCTGCAAATC<br>AATAGCCTGCGTGCCGAAGATACCGCGGTGTACTATTGCGCGCGT<br>TTTGCAATCAAGGGCGACTATTGGGGTCAAGGCACGCTGCTGACC<br>GTGAGCAGCGGTGGTGGCGGCAGCGATATCCAAATGACCCAATCC<br>CCATCCTCCCTGTCTGCAAGCGTTGGTGATCGTGTGACGATTACG | 532 |

TABLE 14-continued

Chimeric Polypeptide Assembly Encoding-construct Sequences

| Construct ID | Tumor Targets | DNA Sequences | SEQ ID NO: |
|---|---|---|---|
| | | TGCCGTGCCTCCCAAGATATCCGTAACTACCTGAATTGGTATCAG CAGAAACCGGGCAAGGCTCCGAAATTGCTGATCTACTACACCAGC CGCCTGGAGTCGGGTGTGCCTAGCCGCTTCAGCGGCAGCGGTTCG GGTACCGACTATACCTTGACCATTAGCAGCCTGCAGCCGGAAGAT TTCGCGACGTATTACTGCCAACAGGGTAACACGCTGCCGTGGACC TTTGGCCAAGGTACCAAAGTCGAGATTAAGGGTGCGACCCCGCCG GAAACCGGTGCGGAAACCGAGAGCCCGGGTGAAACGACTGGCGGC TCTGCAGAGAGCGAGCCGCCAGGTGAGGGCGAAGTCCAACTGGTC GAGTCTGGTGGCGGCCTGGTGCAACCGGGTGGCAGCCTGCGTCTG AGCTGCGCTGCGAGCGGCTATAGCTTTACCGGTTATACCATGAAC TGGGTTCGCCAGGCACCGGGTAAGGGTCTGGAATGGGTGGCGCTG ATCAATCCGTACAAAGGTGTGAGCACTTACAATCAGAAATTCAAA GACCGTTTCACCATTAGCGTTGACAAGAGCAAGAATACCGCGTAT CTGCAGATGAACAGCTTGCGCGCCGAGGATACGGCCGTTTACTAC TGTGCACGTAGCGGCTATTACGGTGACAGCGACTGGTACTTTGAC GTCTGGGGTCAGGGCACGCTGGTCACCGTTAGCAGCGGCACCGCC GAAGCAGCTagcgcctctGGCctgTCAggtCGTtctGATaacCAT tccCCActgGGTctgGCTGGGTCTCCAGGTAGCCCAGCTGGTAGC CCAACCTCTACCGAAGAAGGTACCTCTGAATCCGCTACTCCAGAA TCCGGTCCTGGTACTAGCACTGAGCCAAGCCAAGGTTCTGCTCCA GGCTCCCCGGCAGGTAGCCCTACCTCTACCGAAGAGGGCACTAGC ACCGAACCATCTGAGGGTTCCGCTCCTGGCACCTCCACTGAACCG TCCGAAGGCAGTGCTCCGGGTACTTCCGAAAGCGCAACTCCGGAA TCCGGCCCTGGTTCTGAGCCTGCTACTTCCGGCTCTGAAACTCCA GGTAGCGAGCCAGCGACTTCTGGTTCTGAAACTCCAGGTTCACCG GCGGGTAGCCCGACGAGCACGGAGGAAGGTACCTCTGAGTCGGCC ACTCCTGAGTCCGGTCCGGGCACGAGCACCGAGCCGAGCGAGGGT TCAGCCCGGGTACCAGCACGGAGCCGTCCGAGGGTAGCGCACCG GGTTCTCCGGCGGGCTCCCCTACGTCTACGGAAGAGGGTACGTCC ACTGAACCTAGCGAGGGCAGCGCGCCAGGCACCAGCACTGAACCG AGCGAAGGCAGCGCACCTGGCACTAGCGAGTCTGCGACTCCGGAG AGCGGTCCGGGTACGAGCACGGAACCAAGCGAAGGCAGCGCCCCA GGTACCTCTGAATCTGCTACCCCAGAATCTGGCCCGGGTTCCGAG CCAGCTACCTCTGGTTCTGAAACCCCAGGTACTTCCACTGAACCA AGCGAAGGTAGCGCTCCTGGCACTTCTACTGAACCATCCGAAGGT TCCGCTCCTGGTACGTCTGAAAGCGCTACCCCTGAAAGCGGCCCA GGCACCTCTGAAAGCGCTACTCCTGAGAGCGGTCCAGGCTCTCCA GCAGGTTCTCCAACCTCCACTGAAGAAGGCACCTCTGAGTCTGCT ACCCCTGAATCTGGTCCTGGCTCCGAACCTGCTACCTCTGGTTCC GAAACTCCAGGTACCTCGGAATCTGCGACTCCGGAATCTGGCCCG GGCACGAGCACGGAGCCGTCTGAGGGTAGCGCACCAGGTACCAGC ACTGAGCCTTCTGAGGGCTCTGCACCGGGTACCTCCACGGAACCT TCGGAAGGTTCTGCGCCGGGTACCTCCACTGAGCCATCCGAGGGT TCAGCACCAGGTACTAGCACGGAACCGTCCGAGGGCTCTGCACCA GGTACGAGCACCGAACCGTCGGAGGGTAGCGCTCCAGGTAGCCCA GCGGGCTCTCCGACAAGCACCGAAGAAGGCACCAGCACCGAGCCG TCCGAAGGTTCCGCACCAGGTACAAGCGAGAGCGCGACTCCTGAA TCTGGTCCGGGTAGCGAGCCTGCAACCAGCGGTTCTGAGACGCCG GGCACTTCCGAATCTGCGACCCCGGAGTCCGGTCCAGGTTCAGAG CCGGCGACGAGCGGTTCGGAAACGCCGGGTACGTCTGAATCAGCC ACGCCGGAGTCTGGTCCGGGTACCTCGACCGAACCAAGCGAAGGT TCGGCACCGGGTACTAGCGAGAGCGCAACCCCTGAAAGCGGTCCG GGCAGCCCGGCAGGTTCTCCAACCAGCACCGAAGAAGGTTCCCCT GCTGGTAGCCCGACCTCTACGGAGGAAGGTAGCCCTGCAGGTTCC CCAACTTCTACTGAGGAAGGTACTTCTGAGTCCGCTACCCCAGAA AGCGGTCCTGGTACCTCCACTGAACCGTCTGAAGGCTCTGCACCA GGCACTTCTGAGTCTGCTACTCCAGAAAGCGGCCCAGGTTCTGAA CCAGCAACTTCTGGCTCTGAGACTCCAGGCACTTCTGAGTCCGCA ACGCCTGAATCCGGTCCTGGTTCTGAACCAGCTACTTCCGGCAGC GAAACCCCAGGTACCTCTGAGTCTGCGACTCCAGAGTCTGGTCCT GGTACTTCCACTGAGCCTAGCGAGGGTTCCGCACCAGGTTCTCCG GCTGGTAGCCCGACCAGCACGGAGGAGGGTACGTCTGAATCTGCA ACGCCGGAATCGGGCCCAGGTTCGGAGCCTGCAACGTCTGGCAGC GAAACCCCGGGTACCTCCGAATCTGCTACACCGGAAAGCGGTCCT GGCAGCCCTGCTGGTTCTCCAACCTCTACCGAGGAGGGTTCACCG GCAGGTAGCCCGACTAGCACTGAAGAAGGTACTAGCACGGAGCCG AGCGAGGGTAGTGCTCCGGGTACGAGCGAGAGCGCAACGCCAGAG AGCGGTCCAGGCACCAGCGAATCGGCCACCCCTGAGAGCGGCCCA GGTACTTCTGAGAGCGCCACTCCTGAATCCGGCCCTGGTACGAGC CCGGCAACCTCCGGCTCAGAAACTCCTGGTTCGGAACCAGCGACC AGCGGTTCTGAAACTCCGGGTAGCCCCGGCAGGCAGCCCAACGAGC ACCGAAGAGGGTACCAGCACGGAACCGAGCGAGGGTTCTGCCCCG GGTACTTCCACCGAACCATCGGAGGGCTCTGCACCTGGTAGCGAA CCTGCGACGTCTGGTTCTGAAACGCCGGGTACCAGCGAAAGCGCT | |

TABLE 14-continued

Chimeric Polypeptide Assembly Encoding-construct Sequences

| Construct ID | Tumor Targets | DNA Sequences | SEQ ID NO: |
|---|---|---|---|
| | | ACCCCAGAATCCGGTCCGGGCACTAGCACCGAGCCATCGGAGGGC TCCGCACCAGGTCACCATCATCACCATCAC | |

SEQUENCE LISTING (534 sequences)

SEQ ID NO: 1 - protein, 16 aa, Artificial Sequence
  Description of Artificial Sequence: Synthetic peptide
LSGRSDNHSPLGLAGS

SEQ ID NO: 2 - protein, 16 aa, Artificial Sequence
  Description of Artificial Sequence: Synthetic peptide
SPLGLAGSLSGRSDNH

SEQ ID NO: 3 - protein, 12 aa, Artificial Sequence
  Description of Artificial Sequence: Synthetic peptide
SPLGLSGRSDNH

SEQ ID NO: 4 - protein, 16 aa, Artificial Sequence
  Description of Artificial Sequence: Synthetic peptide
LAGRSDNHSPLGLAGS

SEQ ID NO: 5 - protein, 16 aa, Artificial Sequence
  Description of Artificial Sequence: Synthetic peptide
LSGRSDNHVPLSLKMG

SEQ ID NO: 6 - protein, 8 aa, Artificial Sequence
  Description of Artificial Sequence: Synthetic peptide
SPLGLAGS

SEQ ID NO: 7 - protein, 8 aa, Artificial Sequence
  Description of Artificial Sequence: Synthetic peptide
GPLALARG

SEQ ID NO: 8 - protein, 8 aa, Artificial Sequence
  Description of Artificial Sequence: Synthetic peptide
LSGRSDNH

SEQ ID NO: 9 - protein, 8 aa, Artificial Sequence
  Description of Artificial Sequence: Synthetic peptide
VPLSLTMG

SEQ ID NO: 10 - protein, 8 aa, Artificial Sequence
  Description of Artificial Sequence: Synthetic peptide
VPLSLKMG

SEQ ID NO: 11 - protein, 8 aa, Artificial Sequence
  Description of Artificial Sequence: Synthetic peptide
VPLSLSMG

SEQ ID NO: 12 - protein, 8 aa, Artificial Sequence
  Description of Artificial Sequence: Synthetic peptide
EPLELVAG

SEQ ID NO: 13 - protein, 8 aa, Artificial Sequence
  Description of Artificial Sequence: Synthetic peptide
EPLELRAG

SEQ ID NO: 14 - protein, 8 aa, Artificial Sequence
  Description of Artificial Sequence: Synthetic peptide
EPAALMAG

SEQ ID NO: 15 - protein, 8 aa, Artificial Sequence
  Description of Artificial Sequence: Synthetic peptide
EPASLMAG

SEQ ID NO: 16 - protein, 8 aa, Artificial Sequence
  Description of Artificial Sequence: Synthetic peptide
RIGSLRTA

SEQ ID NO: 17 - protein, 8 aa, Artificial Sequence
  Description of Artificial Sequence: Synthetic peptide
RIQFLRTA

SEQ ID NO: 18 - protein, 8 aa, Artificial Sequence
  Description of Artificial Sequence: Synthetic peptide
EPFHLMAG

SEQ ID NO: 19 - protein, 8 aa, Artificial Sequence
  Description of Artificial Sequence: Synthetic peptide
VPLSLFMG

SEQ ID NO: 20 - protein, 8 aa, Artificial Sequence
  Description of Artificial Sequence: Synthetic peptide
EPLELPAG

SEQ ID NO: 21 - protein, 8 aa, Artificial Sequence
  Description of Artificial Sequence: Synthetic peptide
EPLELAAG

SEQ ID NO: 22 - protein, 119 aa, Artificial Sequence [sequence omitted]

SEQ ID NO: 23 - protein, 122 aa, Artificial Sequence [sequence omitted]

SEQ ID NO: 24 - protein, 119 aa, Artificial Sequence
  Description of Artificial Sequence: Synthetic polypeptide
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS

SEQ ID NO: 25 - protein, 119 aa, Artificial Sequence [sequence omitted]

SEQ ID NO: 26 - protein, 119 aa, Artificial Sequence
  Description of Artificial Sequence: Synthetic polypeptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 27 - protein, 119 aa, Artificial Sequence
  Description of Artificial Sequence: Synthetic polypeptide
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 28 - protein, 125 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 29 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 30 - protein, 125 aa, Artificial Sequence
  Description of Artificial Sequence: Synthetic polypeptide
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 31 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 32 - protein, 107 aa, Artificial Sequence
  Description of Artificial Sequence: Synthetic polypeptide
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 33 - protein, 107 aa, Artificial Sequence [sequence omitted]

SEQ ID NO: 34 - protein, 107 aa, Artificial Sequence
  Description of Artificial Sequence: Synthetic polypeptide
DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR

SEQ ID NO: 35 - protein, 107 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 36 - protein, 106 aa, Artificial Sequence
  Description of Artificial Sequence: Synthetic polypeptide
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 37 - protein, 106 aa, Artificial Sequence
  Description of Artificial Sequence: Synthetic polypeptide
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 38 - protein, 109 aa, Artificial Sequence
  Description of Artificial Sequence: Synthetic polypeptide
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 39 - protein, 109 aa, Artificial Sequence
  Description of Artificial Sequence: Synthetic polypeptide
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 40 - protein, 109 aa, Artificial Sequence
  Description of Artificial Sequence: Synthetic polypeptide
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 41 - protein, 109 aa, Artificial Sequence
  Description of Artificial Sequence: Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 42 - protein, 123 aa, Artificial Sequence [sequence omitted]

SEQ ID NO: 43 - protein, 122 aa, Artificial Sequence
  Description of Artificial Sequence: Synthetic polypeptide
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSS

SEQ ID NO: 44 - protein, 120 aa, Artificial Sequence
  Description of Artificial Sequence: Synthetic polypeptide
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSS

SEQ ID NO: 45 - protein, 121 aa, Artificial Sequence
  Description of Artificial Sequence: Synthetic polypeptide
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSS

SEQ ID NO: 46 - protein, 121 aa, Artificial Sequence
  Description of Artificial Sequence: Synthetic polypeptide
EVQLVESGGGLVQPGGSLRLSCAASGFNIKDTYMHWVRQAPGKGLEWVARIDPANGNSKYVPKFQGRATISADTSKNTAYLQMNSLRAEDTAVYYCAPFGYYVSDYAMAYWGQGTLVTVSS

SEQ ID NO: 47 - protein, 119 aa, Artificial Sequence
  Description of Artificial Sequence: Synthetic polypeptide
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSS

SEQ ID NO: 48 - protein, 121 aa, Artificial Sequence
  Description of Artificial Sequence: Synthetic polypeptide
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 49 - protein, 121 aa, Artificial Sequence
  Description of Artificial Sequence: Synthetic polypeptide
EVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 50 - protein, 124 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 51 - protein, 122 aa, Artificial Sequence
  Description of Artificial Sequence: Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 52 - protein, 122 aa, Artificial Sequence
  Description of Artificial Sequence: Synthetic polypeptide
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSG

SEQ ID NO: 53 - protein, 119 aa, Artificial Sequence
  Description of Artificial Sequence: Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 54 - protein, 122 aa, Artificial Sequence [sequence omitted]

SEQ ID NO: 55 - protein, 121 aa, Artificial Sequence [sequence omitted]

SEQ ID NO: 56 - protein, 122 aa, Artificial Sequence [sequence omitted]

SEQ ID NO: 57 - protein, 114 aa, Artificial Sequence
  Description of Artificial Sequence: Synthetic polypeptide
QLVQSGAEVKKPGSSVKVSCKASGYTITDSNIHWVRQAPGQSLEWIGYIYPYNGGTDYNQKFKNRATLTVDNPTNTAYMELSSLRSEDTDFYYCVNGNPWLAYWGQGTLVTVSS

SEQ ID NO: 58 - protein, 122 aa, Artificial Sequence [sequence omitted]

SEQ ID NO: 59 - protein, 118 aa, Artificial Sequence
  Description of Artificial Sequence: Synthetic polypeptide
QIQLVQSGPEVKKPGETVKISCKASGYTFTNYGMNWVKQAPGKGLKWMGWINTYTGEPTYADAFKGRFAFSLETSASTAYLQINNLKNEDTATYFCARDYGDYGMDYWGQGTSVTVSS

SEQ ID NO: 60 - protein, 118 aa, Artificial Sequence
  Description of Artificial Sequence: Synthetic polypeptide
QVQLQQSGTELMTPGASVTMSCKTSGYTFSTYWIEWVKQRPGHGLEWIGEILGPSGYTDYNEKFKAKATFTADTSSNTAYMQLSSLASEDSAVYYCARWDRLYAMDYWGGGTSVTVSS

SEQ ID NO: 61 - protein, 118 aa, Artificial Sequence
  Description of Artificial Sequence: Synthetic polypeptide
QVQLVESGGGVVQPGRSLRLSCAASGFTFSSYIMHWVRQAPGKGLEWVAVISYDGRNKYYADSVKGRFTISRDNSKNTLYLQMNSLRAEDTAVYYCARDTDGYDFDYWGQGTLVTVSS

SEQ ID NO: 62 - protein, 119 aa, Artificial Sequence
  Description of Artificial Sequence: Synthetic polypeptide
QIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSS

SEQ ID NO: 63 - protein, 118 aa, Artificial Sequence
  Description of Artificial Sequence: Synthetic polypeptide
QVQLVESGGGVVQPGRSLRLSCATSGFTFSDYGMHWVRQAPGKGLEWVAVIWYDGSNKYYADSVKGRFTISRDNSKKTLSLQMNSLRAEDTAVYYCARDSIMVRGDYWGQGTLVTVSS

SEQ ID NO: 64 - protein, 118 aa, Artificial Sequence
  Description of Artificial Sequence: Synthetic polypeptide
QVQLVESGGGVVQPGRSLRLSCAASGFTFSDHGMHWVRQAPGKGLEWVAVIWYDGSNKYYADSVKGRFTISRDNSKNTLYLQMNSLRAEDTAVYYCARDSIMVRGDYWGQGTLVTVSS

SEQ ID NO: 65 - protein, 122 aa, Artificial Sequence
  Description of Artificial Sequence: Synthetic polypeptide
QVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSS

SEQ ID NO: 66 - protein, 117 aa, Artificial Sequence
  Description of Artificial Sequence: Synthetic polypeptide
QVQLVQSGAEVKKPGASVKVSCKASGYTFTSYGFSWVRQAPGQGLEWMGWISASNGNTYYAQKLQGRVTMTTDTSTSTAYMELRSLRSDDTAVYYCARVYADYADYWGQGTLVTVSS

SEQ ID NO: 67 - protein, 115 aa, Artificial Sequence [sequence omitted]

SEQ ID NO: 68 - protein, 119 aa, Artificial Sequence [sequence omitted]

SEQ ID NO: 69 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 70 - protein, 118 aa, Artificial Sequence
  Description of Artificial Sequence: Synthetic polypeptide
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 71 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGIIYYSGSTYYNPSLKSRVTISVDTSKNQFSLKLNSVTAADTAVFYCARVAIVTTIPGGMDVWGQGTTVTVSS

SEQ ID NO: 72 - protein, 120 aa, Artificial Sequence
  Description of Artificial Sequence: Synthetic polypeptide
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 73 - protein, 127 aa, Artificial Sequence
  Description of Artificial Sequence: Synthetic polypeptide
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSS

SEQ ID NO: 74 - protein, 116 aa, Artificial Sequence
  Description of Artificial Sequence: Synthetic polypeptide
QVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARDGPWFAYWGQGTLVTVSA

SEQ ID NO: 75 - protein, 116 aa, Artificial Sequence
  Description of Artificial Sequence: Synthetic polypeptide
QIQLVQSGPELKKPGETVKISCKASGYTFTNYGMNWVRQAPGKGLKWMGWINTYTGEPTYADDFKGRFVFSLETSASTAFLQLNNLRSEDTATYFCVRFISKGDYWGQGTSVTVSS

SEQ ID NO: 76 - protein, 114 aa, Artificial Sequence
  Description of Artificial Sequence: Synthetic polypeptide
VQLQQSDAELVKPGASVKISCKASGYTFTDHAIHWVKQNPEQGLEWIGYFSPGNDDFKYNERFKGKATLTADKSSSTAYVQLNSLTSEDSAVYFCTRSLNMAYWGQGTSVTVSS

SEQ ID NO: 77 - protein, 116 aa, Artificial Sequence
  Description of Artificial Sequence: Synthetic polypeptide
EVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSS

SEQ ID NO: 78 - protein, 116 aa, Artificial Sequence
  Description of Artificial Sequence: Synthetic polypeptide
EVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 79 - protein, 128 aa, Artificial Sequence
  Description of Artificial Sequence: Synthetic polypeptide
EVQLLESGGGLVQPGGSLRLSCAASGFTFSHYMMAWVRQAPGKGLEWVSRIGPSGGPTHYADSVKGRFTISRDNSKNTLYLQMNSLRAEDTAVYYCAGYDSGYDYVAVAGPAEYFQHWGQGTLVTVSS

SEQ ID NO: 80 - protein, 119 aa, Artificial Sequence
  Description of Artificial Sequence: Synthetic polypeptide
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSS

SEQ ID NO: 81 - protein, 118 aa, Artificial Sequence
  Description of Artificial Sequence: Synthetic polypeptide
QVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSS

SEQ ID NO: 82 - protein, 118 aa, Artificial Sequence; identical to SEQ ID NO: 81
  Description of Artificial Sequence: Synthetic polypeptide

SEQ ID NO: 83 - protein, 109 aa, Artificial Sequence
  Description of Artificial Sequence: Synthetic polypeptide
GPELVKPGASVKISCKASDYSFTGYFMNWVMQSHGKSLEWIGRIFPYNGDTFYNQKFKGRATLTVDKSSSTAHMELRSLASEDSAVYFCARGTHYFDYWGQGTTLTVSS

SEQ ID NO: 84 - protein, 115 aa, Artificial Sequence
  Description of Artificial Sequence: Synthetic polypeptide
QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFYSYTYWGQGTLVTVSS

SEQ ID NO: 85 - protein, 117 aa, Artificial Sequence
  Description of Artificial Sequence: Synthetic polypeptide
EVQLVQSGAEVKKPGESLKISCKGSGYSFTSYWIAWVRQMPGKGLEWMGIIFPGDSDTRYSPSFQGQVTISADRSIRTAYLQWSSLKASDTALYYCARTREGYFDYWGQGTLVTVSS

SEQ ID NO: 86 - protein, 117 aa, Artificial Sequence
  Description of Artificial Sequence: Synthetic polypeptide
EVQLVQSGAEVKKPGESLKISCKGSGYSFTNYWIAWVRQMPGKGLEWMGIIYPGDSDTRYSPSFQGQVTISADKSIRTAYLQWSSLKASDTAMYYCARTREGYFDYWGQGTLVTVSS

SEQ ID NO: 87 - protein, 117 aa, Artificial Sequence
  Description of Artificial Sequence: Synthetic polypeptide
EVQLVQSGADVTKPGESLKISCKVSGYRFTNYWIGWMRQMSGKGLEWMGIIYPGDSDTRYSPSFQGHVTISADKSINTAYLRWSSLKASDTAIYYCARTREGFFDYWGQGTPVTVSS

SEQ ID NO: 88 - protein, 124 aa, Artificial Sequence
  Description of Artificial Sequence: Synthetic polypeptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS

SEQ ID NO: 89 - protein, 119 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 90 - protein, 120 aa, Artificial Sequence [sequence omitted]

SEQ ID NO: 91 - protein, 125 aa, Artificial Sequence [sequence omitted]

SEQ ID NO: 92 - protein, 121 aa, Artificial Sequence [sequence omitted]

SEQ ID NO: 93 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGSIIPIFGTVNYAQKFQGRVTITADESTSTAYMELSSLRSEDTAVYYCARDPSVNLYWYFDLWGRGTLVTVSS

SEQ ID NO: 94 - protein, 119 aa, Artificial Sequence
  Description of Artificial Sequence: Synthetic polypeptide
QVQLVQSGAEVKKPGSSVKVSCKASGGTFGSYAISWVRQAPGQGLEWMGSIIPIFGAANPAQKSQGRVTITADESTSTAYMELSSLRSEDTAVYYCAKMGRGKVAFDIWGQGTMVTVSS

SEQ ID NO: 95 - protein, 123 aa, Artificial Sequence
  Description of Artificial Sequence: Synthetic polypeptide
QVQLVQSGAEVKKPGASVKVSCKASGYAFTSYGINWVRQAPGQGLEWMGWISAYNGNTYYAQKLRGRVTMTTDTSTSTAYMELRSLRSDDTAVYYCARDLGGYGSGSVPFDPWGQGTLVTVSS

SEQ ID NO: 96 - protein, 123 aa, Artificial Sequence [sequence omitted]

SEQ ID NO: 97 - protein, 119 aa, Artificial Sequence [sequence omitted]

SEQ ID NO: 98 - protein, 118 aa, Artificial Sequence
  Description of Artificial Sequence: Synthetic polypeptide
QIQLVQSGPELKKPGETVKISCKASGYTFTEYPIHWVKQAPGKGFKWMGMIYTDIGKPTYAEEFKGRFAFSLETSASTAYLQINNLKNEDTATYFCVRDRYDSLFDYWGQGTTLTVSS

SEQ ID NO: 99 - protein, 121 aa, Artificial Sequence
  Description of Artificial Sequence: Synthetic polypeptide
EMQLVESGGGFVKPGGSLKLSCAASGFAFSHYDMSWVRQTPKQRLEWVAYIASGGDITYYADTVKGRFTISRDNAQNTLYLQMSSLKSEDTAMFYCSRSSYGNNGDALDFWGQGTSVTVSS

SEQ ID NO: 100 - protein, 119 aa, Artificial Sequence
  Description of Artificial Sequence: Synthetic polypeptide
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSS

SEQ ID NO: 101 - protein, 115 aa, Artificial Sequence
  Description of Artificial Sequence: Synthetic polypeptide
QVQLLQSAAEVKKPGESLKISCKGSGYSFTSYWIGWVRQMPGKGLEWMGIIYPGDSDTRYSPSFQGQVTISADKSISTAYLQWSSLKASDTAVYYCARWRDSPLWGQGTLVTVSS

SEQ ID NO: 102 - protein, 120 aa, Artificial Sequence [sequence omitted]

SEQ ID NO: 103 - protein, 120 aa, Artificial Sequence
  Description of Artificial Sequence: Synthetic polypeptide
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS

SEQ ID NO: 104 - protein, 119 aa, Artificial Sequence
  Description of Artificial Sequence: Synthetic polypeptide
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSS

SEQ ID NO: 105 - protein, 119 aa, Artificial Sequence [sequence omitted]

SEQ ID NO: 106 - protein, 119 aa, Artificial Sequence [sequence omitted]

SEQ ID NO: 107 - protein, 121 aa, Artificial Sequence [sequence omitted]

SEQ ID NO: 108 - protein, 118 aa, Artificial Sequence
  Description of Artificial Sequence: Synthetic polypeptide
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSS

SEQ ID NO: 109 - protein, 129 aa, Artificial Sequence
  Description of Artificial Sequence: Synthetic polypeptide
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSS

SEQ ID NO: 110 - protein, 119 aa, Artificial Sequence
  Description of Artificial Sequence: Synthetic polypeptide
EVQLVESGGGVVQPGRSLRLSCSTSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSS

SEQ ID NO: 111 - protein, 120 aa, Artificial Sequence
  Description of Artificial Sequence: Synthetic polypeptide
QVELVQSGAEVKKPGESLKISCKGSGYSFTSYWIGWVRQAPGKGLEWMGIIDPGDSRTRYSPSFQGQVTISADKSISTAYLQWSSLKASDTAMYYCARGQLYGGTYMDGWGQGTLVTVSS

SEQ ID NO: 112 - protein, 119 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSS

SEQ ID NO: 113 - protein, 122 aa, Artificial Sequence
  Description of Artificial Sequence: Synthetic polypeptide
QVYLVESGGGVVQPGRSLRLSCAASGITFSIYGMHWVRQAPGKGLEWVAVIWYDGSHEYYADSVKGRFTISRDNSKNTLYLLMNSLRAEDTAVYYCARDGDYYDSGSPLDYWGQGTLVTVSS

SEQ ID NO: 114 - protein, 122 aa, Artificial Sequence
  Description of Artificial Sequence: Synthetic polypeptide
QVHLVESGGGVVQPGRSLRLSCVASGITFRIYGMHWVRQAPGKGLEWVAVLWYDGSHEYYADSVKGRFTISRDNSKNTLYLQMNSLRAEDTAIYYCARDGDYYDSGSPLDYWGQGTLVTVSS

SEQ ID NO: 115 - protein, 131 aa, Artificial Sequence
  Description of Artificial Sequence: Synthetic polypeptide
EVHLVESGGGLVQPGGSLRLSCAASGFTFSRYWMSWVRQAQGKGLEWVASIKQAGSEKTYVDSVKGRFTISRDNAKNSLSLQMNSLRAEDTAVYYCAREGAYYYDSASYYPYYYYYSMDVWGQGTTVTVSS

SEQ ID NO: 116 - protein, 119 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGSGTPVTVSS

SEQ ID NO: 117 - protein, 119 aa, Artificial Sequence
  Description of Artificial Sequence: Synthetic polypeptide
EVQLQESGPELVKPGASVKMSCKASGYTFPSYVLHWVKQKPGQGLEWIGYINPYNDGTQYNEKFKGKATLTSDKSSSTAYMELSRLTSEDSAVYYCARGFGGSYGFAYWGQGTLITVSA

SEQ ID NO: 118 - protein, 119 aa, Artificial Sequence
  Description of Artificial Sequence: Synthetic polypeptide
QVQLQQSGAEVKKFGASVKVSCEASGYTFPSYVLHWVKQAPGQGLEWIGYINPYNDGTQTNKKFKGKATLTRDTSINTAYMELSRLRSDDTAVYYCARGFGGSYGFAYNGQGTLVTVSS

SEQ ID NO: 119 - protein, 117 aa, Artificial Sequence
  Description of Artificial Sequence: Synthetic polypeptide
QAQLQVSGAEVVKPGASVKMSCKASGYTFTSYNMHWVKQTPGQGLEWIGYIYPGNGATNYNQKFQGKATLTADTSSSTAYMQISSLTSEDSAVYFCARGDSVPFAYWGQGTLVTVSA

SEQ ID NO: 120 - protein, 118 aa, Artificial Sequence
  Description of Artificial Sequence: Synthetic polypeptide
QVQLQQSGAELMKPGASVKISCKATGYTFSAYWIEWVKQRPGHGLEWIGEILPGSNNSRYNEKFKGKATFTADTSSNTAYMQLSSLTSEDSAVYYCSRSYDFAWFAYWGQGTPVTVSA

SEQ ID NO: 121 - protein, 118 aa, Artificial Sequence
  Description of Artificial Sequence: Synthetic polypeptide
QVQLVQSGAEVKKPGASVKVSCKASGYTFSAYWIEWVRQAPGKGLEWVGEILPGSNNSRYNEKFKGRVTVTRDTSTNTAYMELSSLRSEDTAVYYCARSYDFAWFAYWGQGTLVTVSS

SEQ ID NO: 122 - protein, 123 aa, Artificial Sequence
  Description of Artificial Sequence: Synthetic polypeptide
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 123 - protein, 121 aa, Artificial Sequence
  Description of Artificial Sequence: Synthetic polypeptide
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 124 - protein, 118 aa, Artificial Sequence [sequence omitted]

SEQ ID NO: 125 - protein, 120 aa, Artificial Sequence
  Description of Artificial Sequence: Synthetic polypeptide
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 126 - protein, 115 aa, Artificial Sequence
  Description of Artificial Sequence: Synthetic polypeptide
EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 127 - protein, 121 aa, Artificial Sequence
  Description of Artificial Sequence: Synthetic polypeptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS

SEQ ID NO: 128 - protein, 121 aa, Artificial Sequence
  Description of Artificial Sequence: Synthetic polypeptide
QEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISS

SEQ ID NO: 129 - protein, 119 aa, Artificial Sequence
  Description of Artificial Sequence: Synthetic polypeptide
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 130 - protein, 117 aa, Artificial Sequence
  Description of Artificial Sequence: Synthetic polypeptide
QSLEESGGRLVTPGTPLTLTCTVSGIDLNSHWMSWVRQAPGKGLEWIGIIAASGSTYYANWAKGRFTISKTSTTVDLRIASPTTEDTATYFCARDYGDYRLVTFNIWGPGTLVTVSS

SEQ ID NO: 131 - protein, 116 aa, Artificial Sequence
  Description of Artificial Sequence: Synthetic polypeptide
QSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYCDFNIWGPGTLVTISS

SEQ ID NO: 132 - protein, 115 aa, Artificial Sequence
  Description of Artificial Sequence: Synthetic polypeptide
QVQLVQSGAEVVKPGASVKISCKASGYTFTDHAIHWVKQNPGQRLEWIGYFSPGNDDFKYNERFKGKATLTADTSASTAYVELSSLRSEDTAVYFCTRSLNMAYWGQGTLVTVSS

SEQ ID NO: 133 - protein, 119 aa, Artificial Sequence
  Description of Artificial Sequence: Synthetic polypeptide
  MOD_RES (68)..(68): Any amino acid
QIQLVQSGPELKKPGETVKISCKASGYTFTNFGMNWVKQGPGEGLKWMGWINTNTGEPRYAEEFKGRXAFSLETTASTAYLQINNLKNEDTATYFCARDWDGAYFFDYWGQGTTLTVSS

SEQ ID NO: 134 - protein, 117 aa, Artificial Sequence
  Description of Artificial Sequence: Synthetic polypeptide
QVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSS

SEQ ID NO: 135 - protein, 122 aa, Artificial Sequence
  Description of Artificial Sequence: Synthetic polypeptide
  MOD_RES (97)..(97): Any amino acid
EVQLVESGGGLVQPKGSLKLSCAASGFTFNTYAMNWVRQAPGKGLEWVARIRSKSNNYATYYADSVKDRFTISRDDSQSMLYLQMNNLKTEDTAMYXCVRQWDYDVRAMNYWGQGTSVTVSS

SEQ ID NO: 136 - protein, 121 aa, Artificial Sequence
  Description of Artificial Sequence: Synthetic polypeptide
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSS

SEQ ID NO: 137 - protein, 126 aa, Artificial Sequence
  Description of Artificial Sequence: Synthetic polypeptide
QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSS

SEQ ID NO: 138 - protein, 117 aa, Artificial Sequence
  Description of Artificial Sequence: Synthetic polypeptide
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSA

SEQ ID NO: 139 - protein, 117 aa, Artificial Sequence
  Description of Artificial Sequence: Synthetic polypeptide
EVQLVESGGGLVQPGGSLRLSCAASGFTFSSYGMSWVRQAPGKGLEWVATITSGGSYTYYVDSVKGRFTISRDNAKNTLYLQMNSLRAEDTAVYYCVRIGEDALDYWGQGTLVTVSS

SEQ ID NO: 140 - protein, 118 aa, Artificial Sequence
  Description of Artificial Sequence: Synthetic polypeptide
KVQLQQSGTELVKPGASVKVSCKASGYIFTEYIIHWVKQRSGQGLEWIGWLYPESNIIKYNEKFKDKATLTADKSSSTVYMELSRLTSEDSAVYFCTRHDGTNFDYWGQGTTLTVSSA

SEQ ID NO: 141 - protein, 106 aa, Artificial Sequence [sequence omitted]

SEQ ID NO: 142 - protein, 107 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIK

SEQ ID NO: 143 - protein, 106 aa, Artificial Sequence
  Description of Artificial Sequence: Synthetic polypeptide
ENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIK

SEQ ID NO: 144 - protein, 111 aa, Artificial Sequence
  Description of Artificial Sequence: Synthetic polypeptide
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIK

SEQ ID NO: 145 - protein, 106 aa, Artificial Sequence
  Description of Artificial Sequence: Synthetic polypeptide
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIK

SEQ ID NO: 146 - protein, 107 aa, Artificial Sequence
  Description of Artificial Sequence: Synthetic polypeptide
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKR

SEQ ID NO: 147 - protein, 116 aa, Artificial Sequence
  Description of Artificial Sequence: Synthetic polypeptide
QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 148 - protein, 111 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 149 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 150 - protein, 106 aa, Artificial Sequence [sequence omitted]

SEQ ID NO: 151 - protein, 112 aa, Artificial Sequence
  Description of Artificial Sequence: Synthetic polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 152 - protein, 106 aa, Artificial Sequence [sequence omitted]

SEQ ID NO: 153 - protein, 106 aa, Artificial Sequence [sequence omitted]

SEQ ID NO: 154 - protein, 111 aa, Artificial Sequence [sequence omitted]

SEQ ID NO: 155 - protein, 107 aa, Artificial Sequence [sequence omitted]

SEQ ID NO: 156 - protein, 111 aa, Artificial Sequence
  Description of Artificial Sequence: Synthetic polypeptide
DIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIK

SEQ ID NO: 157 - protein, 111 aa, Artificial Sequence
  Description of Artificial Sequence: Synthetic polypeptide
DIVLTQSPASLTVSLGQKTTISCRASKSVSTSGYSFMHWYQLKPGQSPKLLIYLASDLPSGVPARFSGSGSGTDFTLKIHPVEEEDAATYYCQHSREIPYTFGGGTKLEIT

SEQ ID NO: 158 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRTNWPLTFGGGTKVEIK

SEQ ID NO: 159 - protein, 107 aa, Artificial Sequence
  Description of Artificial Sequence: Synthetic polypeptide
AIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIK

SEQ ID NO: 160 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 161 - protein, 107 aa, Artificial Sequence
  Description of Artificial Sequence: Synthetic polypeptide
EIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIK

SEQ ID NO: 162 - protein, 107 aa, Artificial Sequence
  Description of Artificial Sequence: Synthetic polypeptide
DIQMTQSPSSVSASVGDRVTITCRASQGINTWLAWYQQKPGKAPKLLIYAASSLKSGVPSRFSGSGSGTDFTLTISSLQPEDFATYYCQQANSFPLTFGGGTKVEIK

SEQ ID NO: 163 - protein, 108 aa, Artificial Sequence [sequence omitted]

SEQ ID NO: 164 - protein, 113 aa, Artificial Sequence [sequence omitted]

SEQ ID NO: 165 - protein, 107 aa, Artificial Sequence
  Description of Artificial Sequence: Synthetic polypeptide
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 166 - protein, 108 aa, Artificial Sequence
  Description of Artificial Sequence: Synthetic polypeptide
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 167 - protein, 107 aa, Artificial Sequence
  Description of Artificial Sequence: Synthetic polypeptide
EIVLTQSPDFQSVTPKEKVTITCRASQSIGISLHWYQQKPDQSPKLLIKYASQSFSGVPSRFSGSGSGTDFTLTINSLEAEDAATYYCHQSRSFPWTFGQGTKVEIK

SEQ ID NO: 168 - protein, 113 aa, Artificial Sequence
  Description of Artificial Sequence: Synthetic polypeptide
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 169 - protein, 107 aa, Artificial Sequence
  Description of Artificial Sequence: Synthetic polypeptide
ELQMTQSPSSLSASVGDRVTITCRTSQSISSYLNWYQQKPGQPPKLLIYWASTRESGVPDRFSGSGSGTDFTLTISSLQPEDSATYYCQQSYDIPYTFGQGTKLEIK

SEQ ID NO: 170 - protein, 107 aa, Artificial Sequence
  Description of Artificial Sequence: Synthetic polypeptide
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIK

SEQ ID NO: 171 - protein, 106 aa, Artificial Sequence
  Description of Artificial Sequence: Synthetic polypeptide
QILLTQSPAIMSASPGEKVTMTCSASSSVSYMLWYQQKPGSSPKPWIFDTSNLASGFPARFSGSGSGTSYSLIISSMEAEDAATYYCHQRSGYPYTFGGGTKLEIK

SEQ ID NO: 172 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSYPLTFGGGTKVKES

SEQ ID NO: 173 - protein, 112 aa, Artificial Sequence
  Description of Artificial Sequence: Synthetic polypeptide
DIVMTQSPLSLPVTPGEPASISCRSSINKKGSNGITYLYWYLQKPGQSPQLLIYQMSNLASGVPDRFSGSGSGTDFTLKISRVEAEDVGVYYCAQNLEIPRTFGQGTKVEIK

SEQ ID NO: 174 - protein, 112 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIK

SEQ ID NO: 175 - protein, 112 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELK

SEQ ID NO: 176 - protein, 107 aa, Artificial Sequence
  Description of Artificial Sequence: Synthetic polypeptide
DIQMTQSPSSLSASVGDRVTITCRASQSISTWLAWYQQKPGKAPKLLIYKASNLHTGVPSRFSGSGSGTEFSLTISGLQPDDFATYYCQQYNSYSRTFGQGTKVEIK

SEQ ID NO: 177 - protein, 110 aa, Artificial Sequence
  Description of Artificial Sequence: Synthetic polypeptide
DIQLTQSPSSLSASVGDRVTITCSVSSSISSNNLHWYQQKPGKAPKPWIYGTSNLASGVPSRFSGSGSGTDYTFTISSLQPEDIATYYCQQWSSYPYMYTFGQGTKVEIK

SEQ ID NO: 178 - protein, 111 aa, Artificial Sequence
  Description of Artificial Sequence: Synthetic polypeptide
DIVLTQSPLSLAVSLGQPAIISCKASQSVSFAGTSLMHWYHQKPGQQPRLLIYRASNLEAGVPDRFSGSGSKTDFTLNISPVEAEDAATYYCQQSREYPYTFGGGTKLEIK

SEQ ID NO: 179 - protein, 111 aa, Artificial Sequence
  Description of Artificial Sequence: Synthetic polypeptide
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIK

SEQ ID NO: 180 - protein, 100 aa, Artificial Sequence
  Description of Artificial Sequence: Synthetic polypeptide
PASLSASVGETVTITCRTSENIFSYLAWYQQKQGISPQLLVYNAKTLAEGVPSRFSGSGSGTQFSLKINSLQPEDFGSYYCQHHYAFPWTFGGGSKLEIK

SEQ ID NO: 181 - protein, 112 aa, Artificial Sequence
  Description of Artificial Sequence: Synthetic polypeptide
DVVMTQSPLSLPVTPGEPASISCRSSQSLVHSNGNTYLHWYLQKPGQSPQLLIYKVSNRFSGVPDRFSGSGSGTDFTLKISRVEAEDVGVYYCSQNTHVPPTFGQGTKLEIK

SEQ ID NO: 182 - protein, 107 aa, Artificial Sequence
  Description of Artificial Sequence: Synthetic polypeptide
EIVLTQSPGTLSLSPGERATLSCRAVQSVSSSYLAWYQQKPGQAPRLLIYGASSRATGIPDRFSGSGSGTDFTLTISRLEPEDFAVYYCQQYGSSPTFGGGTKVEIK

SEQ ID NO: 183 - protein, 107 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 184 - protein, 107 aa, Artificial Sequence
  Description of Artificial Sequence: Synthetic polypeptide
EILLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTKVEIK

SEQ ID NO: 185 - protein, 112 aa, Artificial Sequence
  Description of Artificial Sequence: Synthetic polypeptide
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 186 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 187 - protein, 106 aa, Artificial Sequence [sequence omitted]

SEQ ID NO: 188 - protein, 107 aa, Artificial Sequence [sequence omitted]

SEQ ID NO: 189 - protein, 107 aa, Artificial Sequence [sequence omitted]

SEQ ID NO: 190 - protein, 107 aa, Artificial Sequence
  Description of Artificial Sequence: Synthetic polypeptide
DIQMTQSPSTLSASVGDRVTITCRASQSISSWWAWYQQKPGKAPKLLIYDASSLESGVPSRFSGSGSGTEFTLTISSLQPDDFATYYCQQYHAHPTTFGGGTKVEIK

SEQ ID NO: 191 - protein, 113 aa, Artificial Sequence
  Description of Artificial Sequence: Synthetic polypeptide
DIVMTQSPDSLAVSLGERATINCKSSQSVLYSPNNKNYLAWYQQKPGQPPKLLIYWASTRESGVPDRFSGSGSGTDFTLTISSLQAEDVAVYYCQQYYGSPITFGGGTKVEIK

SEQ ID NO: 192 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQDYRTWPRRVFGGGTKVEIK

SEQ ID NO: 193 - protein, 112 aa, Artificial Sequence [sequence omitted]

SEQ ID NO: 194 - protein, 107 aa, Artificial Sequence [sequence omitted]

SEQ ID NO: 195 - protein, 112 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 196 - protein, 111 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVLTFGSGTKLEIK

SEQ ID NO: 197 - protein, 102 aa, Artificial Sequence
  Description of Artificial Sequence: Synthetic polypeptide
QSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIK

SEQ ID NO: 198 - protein, 110 aa, Artificial Sequence
  Description of Artificial Sequence: Synthetic polypeptide
QAVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGQYVFGGGTKLTVL

SEQ ID NO: 199 - protein, 107 aa, Artificial Sequence [sequence omitted]

SEQ ID NO: 200 - protein, 107 aa, Artificial Sequence
  Description of Artificial Sequence: Synthetic polypeptide
DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIK

SEQ ID NO: 201 - protein, 111 aa, Artificial Sequence
  Description of Artificial Sequence: Synthetic polypeptide
QSVLTQPPSVSGAPGQRVTISCTGSSSNIGAGYGVHWYQQLPGTAPKLLIYGNTNRPSGVPDRFSGFKSGTSASLAITGLQAEDEADYYCQFYDSSLSGWVFGGGTKLTVL

SEQ ID NO: 202 - protein, 107 aa, Artificial Sequence [sequence omitted]

SEQ ID NO: 203 - protein, 111 aa, Artificial Sequence [sequence omitted]

SEQ ID NO: 204 - protein, 107 aa, Artificial Sequence [sequence omitted]

SEQ ID NO: 205 - protein, 111 aa, Artificial Sequence
  Description of Artificial Sequence: Synthetic polypeptide
QSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVL

SEQ ID NO: 206 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVL

SEQ ID NO: 207 - protein, 112 aa, Artificial Sequence
  Description of Artificial Sequence: Synthetic polypeptide
DIQMTQSPSSLSASVGDRVTITCRSSQRIVHSNGNTYLEWYQQTPGKAPKLLIYKVSNRFSGVPSRFSGSGSGTDFTFTISSLQPEDIATYYCFQGSHVPFTFGQGTKLQIT

SEQ ID NO: 208 - protein, 111 aa, Artificial Sequence
  Description of Artificial Sequence: Synthetic polypeptide
DIALTQPASVSGSPGQSITISCTGTSSDIGGYNSVSWYQQHPGKAPKLMIYGVNNRPSGVSNRFSGSKSGNTASLTISGLQAEDEADYYCSSYDIESATPVFGGGTKLTVL

SEQ ID NO: 209 - protein, 106 aa, Artificial Sequence
  Description of Artificial Sequence: Synthetic polypeptide
DIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIK

SEQ ID NO: 210 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 211 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSQYTFGQGTKLEIK

SEQ ID NO: 212 - protein, 106 aa, Artificial Sequence
  Description of Artificial Sequence: Synthetic polypeptide
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGSGTKVEIK

SEQ ID NO: 213 - protein, 108 aa, Artificial Sequence
  Description of Artificial Sequence: Synthetic polypeptide
DIVMTQSPAIMSASPGEKVTMTCSASSSVSSSYLYWYQQKPGSSPKLWIYSTSNLASGVPARFSGSGSGTSYSLTISSMEAEDAASYFCHQWNRYPYTFGGGTKLEIK

SEQ ID NO: 214 - protein, 108 aa, Artificial Sequence
  Description of Artificial Sequence: Synthetic polypeptide
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIK

SEQ ID NO: 215 - protein, 106 aa, Artificial Sequence
  Description of Artificial Sequence: Synthetic polypeptide
EIVLTQSPATMSASPGERVTITCSAHSSVSFMHWFQQKPGTSPKLWIYSTSSLASGVPARFGGSGSGTSYSLTISSMEAEDAATYYCQQRSSFPLTFGAGTKLELK

SEQ ID NO: 216 - protein, 113 aa, Artificial Sequence
  Description of Artificial Sequence: Synthetic polypeptide
DIVMSQSPSSLAVSVGEKVTMSCKSSQSLLYSSNQKIYLAWYQQKPGQSPKLLIYWASTRESGVPDRFTGGGSGTDFTLTISSVKAEDLAVYYCQQYYRYPRTFGGGTKLEIK

SEQ ID NO: 217 - protein, 113 aa, Artificial Sequence
  Description of Artificial Sequence: Synthetic polypeptide
DIQMTQSPSSLSASVGDRVTITCKSSQSLLYSSNQKIYLAWYQQKPGKAPKLLIYWASTRESGVPSRFSGSGSGTDFTFTISSLQPEDIATYYCQQYYRYPRTFGQGTKVEIK

SEQ ID NO: 218 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 219 - protein, 108 aa, Artificial Sequence
  Description of Artificial Sequence: Synthetic polypeptide
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 220 - protein, 107 aa, Artificial Sequence [sequence omitted]

SEQ ID NO: 221 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 222 - protein, 107 aa, Artificial Sequence
  Description of Artificial Sequence: Synthetic polypeptide
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK

SEQ ID NO: 223 - protein, 107 aa, Artificial Sequence
  Description of Artificial Sequence: Synthetic polypeptide
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 224 - protein, 112 aa, Artificial Sequence
  Description of Artificial Sequence: Synthetic polypeptide
ELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTG

SEQ ID NO: 225 - protein, 107 aa, Artificial Sequence
  Description of Artificial Sequence: Synthetic polypeptide
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMK

SEQ ID NO: 226 - protein, 108 aa, Artificial Sequence
  Description of Artificial Sequence: Synthetic polypeptide
ELVMTQTPSSVSAAVGGTVTINCQASQSIGSYLAWYQQKPGQPPKLLIYYASNLASGVPSRFSGSGSGTEYTLTISGVQREDAATYYCLGSLSNSDNVFGGGTELEIL

SEQ ID NO: 227 - protein, 110 aa, Artificial Sequence
  Description of Artificial Sequence: Synthetic polypeptide
ELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVK

SEQ ID NO: 228 - protein, 113 aa, Artificial Sequence
  Description of Artificial Sequence: Synthetic polypeptide
DIVMSQSPDSLAVSLGERVTLNCKSSQSLLYSGNQKNYLAWYQQKPGQSPKLLIYWASARESGVPDRFSGSGSGTDFTLTISSVQAEDVAVYYCQQYYSYPLTFGAGTKLELK

SEQ ID NO: 229 - protein, 107 aa, Artificial Sequence
  Description of Artificial Sequence: Synthetic polypeptide
SIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIK

SEQ ID NO: 230 - protein, 115 aa, Artificial Sequence
  Description of Artificial Sequence: Synthetic polypeptide
SVIMSRGQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELK

SEQ ID NO: 231 - protein, 107 aa, Artificial Sequence
  Description of Artificial Sequence: Synthetic polypeptide
DIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIK

SEQ ID NO: 232 - protein, 107 aa, Artificial Sequence
  Description of Artificial Sequence: Synthetic polypeptide
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIK

SEQ ID NO: 233 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 234 - protein, 107 aa, Artificial Sequence [sequence omitted]

SEQ ID NO: 235 - protein, 107 aa, Artificial Sequence
  Description of Artificial Sequence: Synthetic polypeptide
DIQMTQSPSSLSASVGDRVTITCRASQDIAGSLNWLQQKPGKAIKRLIYATSSLDSGVPKRFSGSRSGSDYTLTISSLQPEDFATYYCLQYGSFPPTFGQGTKVEIK

SEQ ID NO: 236 - protein, 111 aa, Artificial Sequence
  Description of Artificial Sequence: Synthetic polypeptide
DIVLTQSPASLAVSLGQRATISCRASESVDSYGNSFMHWYQQKPGQPPKLLIYRASNLESGIPARFSGSGSRTDFTLTINPVEADDVATYYCQQSNEDPLTFGAGTKLELK

SEQ ID NO: 237 - protein, 11 aa, Artificial Sequence
  Description of Artificial Sequence: Synthetic peptide
RASQDIRNYLN

SEQ ID NO: 238 - protein, 7 aa, Artificial Sequence
  Description of Artificial Sequence: Synthetic peptide
YTSRLES

SEQ ID NO: 239 - protein, 9 aa, Artificial Sequence
  Description of Artificial Sequence: Synthetic peptide
QQGNTLPWT

SEQ ID NO: 240 - protein, 10 aa, Artificial Sequence
  Description of Artificial Sequence: Synthetic peptide
GYSFTGYTMN

SEQ ID NO: 241 - protein, 10 aa, Artificial Sequence
  Description of Artificial Sequence: Synthetic peptide
LINPYKGVST

SEQ ID NO: 242 - protein, 13 aa, Artificial Sequence
  Description of Artificial Sequence: Synthetic peptide
SGYYGDSDWYFDV

SEQ ID NO: 243 - protein, 16 aa, Artificial Sequence
  Description of Artificial Sequence: Synthetic peptide
LSGRSDNHSPLGLAGS

SEQ ID NO: 244 - protein, 16 aa, Artificial Sequence
  Description of Artificial Sequence: Synthetic peptide
SPLGLAGSLSGRSDNH

SEQ ID NO: 245 - protein, 12 aa, Artificial Sequence
  Description of Artificial Sequence: Synthetic peptide
SPLGLSGRSDNH

SEQ ID NO: 246 - protein, 16 aa, Artificial Sequence
  Description of Artificial Sequence: Synthetic peptide
LAGRSDNHSPLGLAGS

SEQ ID NO: 247 - protein, 16 aa, Artificial Sequence
  Description of Artificial Sequence: Synthetic peptide
LAGRSDNHVPLSLSMG

SEQ ID NO: 248 - protein, 16 aa, Artificial Sequence
  Description of Artificial Sequence: Synthetic peptide
LAGRSDNHEPLELVAG

SEQ ID NO: 249 - protein, 16 aa, Artificial Sequence
  Description of Artificial Sequence: Synthetic peptide
LSGRSDNHVPLSLKMG

SEQ ID NO: 250 - protein, 8 aa, Artificial Sequence
  Description of Artificial Sequence: Synthetic peptide
SPLGLAGS

SEQ ID NO: 251 - protein, 8 aa, Artificial Sequence
  Description of Artificial Sequence: Synthetic peptide
GPLGLARG

SEQ ID NO: 252 - protein, 8 aa, Artificial Sequence
  Description of Artificial Sequence: Synthetic peptide
LSGRSDNH

SEQ ID NO: 253 - protein, 8 aa, Artificial Sequence
  Description of Artificial Sequence: Synthetic peptide
GTAHLMGG

SEQ ID NO: 254 - protein, 8 aa, Artificial Sequence
  Description of Artificial Sequence: Synthetic peptide
RIGSLRTA

SEQ ID NO: 255 - protein, 8 aa, Artificial Sequence
  Description of Artificial Sequence: Synthetic peptide
RIGALRTA

SEQ ID NO: 256 - protein, 8 aa, Artificial Sequence
  Description of Artificial Sequence: Synthetic peptide
RIGWLRTA

SEQ ID NO: 257 - protein, 8 aa, Artificial Sequence
  Description of Artificial Sequence: Synthetic peptide
RIGNLRTA

SEQ ID NO: 258 - protein, 8 aa, Artificial Sequence
  Description of Artificial Sequence: Synthetic peptide
RIGFLRTA

SEQ ID NO: 259 - protein, 8 aa, Artificial Sequence
  Description of Artificial Sequence: Synthetic peptide
RIFFLRTA

SEQ ID NO: 260 - protein, 8 aa, Artificial Sequence
  Description of Artificial Sequence: Synthetic peptide
RILFLRTA

SEQ ID NO: 261 - protein, 8 aa, Artificial Sequence
  Description of Artificial Sequence: Synthetic peptide
RIYFLRTA

SEQ ID NO: 262 - protein, 8 aa, Artificial Sequence
  Description of Artificial Sequence: Synthetic peptide
RIQFLRTA

SEQ ID NO: 263 - protein, 8 aa, Artificial Sequence
  Description of Artificial Sequence: Synthetic peptide
EPAALMAG

SEQ ID NO: 264 - protein, 8 aa, Artificial Sequence
  Description of Artificial Sequence: Synthetic peptide
EPANLMAG

SEQ ID NO: 265 - protein, 8 aa, Artificial Sequence
  Description of Artificial Sequence: Synthetic peptide
EPASLMAG

SEQ ID NO: 266 - protein, 8 aa, Artificial Sequence
  Description of Artificial Sequence: Synthetic peptide
EPFHLMAG

SEQ ID NO: 267 - protein, 8 aa, Artificial Sequence
  Description of Artificial Sequence: Synthetic peptide
EPWHLMAG

SEQ ID NO: 268 - protein, 8 aa, Artificial Sequence
  Description of Artificial Sequence: Synthetic peptide
EPRHLMAG

SEQ ID NO: 269 - protein, 8 aa, Artificial Sequence
  Description of Artificial Sequence: Synthetic peptide
VPLSLFMG

SEQ ID NO: 270 - protein, 8 aa, Artificial Sequence
  Description of Artificial Sequence: Synthetic peptide
VPLSLHMG

SEQ ID NO: 271 - protein, 8 aa, Artificial Sequence
  Description of Artificial Sequence: Synthetic peptide
VPLSLQAG

SEQ ID NO: 272 - protein, 8 aa, Artificial Sequence
  Description of Artificial Sequence: Synthetic peptide
VPLSLTMG

SEQ ID NO: 273 - protein, 8 aa, Artificial Sequence
  Description of Artificial Sequence: Synthetic peptide
VPLSLKMG

SEQ ID NO: 274 - protein, 8 aa, Artificial Sequence
  Description of Artificial Sequence: Synthetic peptide
VPLSLSMG

SEQ ID NO: 275 - protein, 8 aa, Artificial Sequence
  Description of Artificial Sequence: Synthetic peptide
VPLSLNAG

SEQ ID NO: 276 - protein, 8 aa, Artificial Sequence
  Description of Artificial Sequence: Synthetic peptide
VPLSLLMG

SEQ ID NO: 277 - protein, 8 aa, Artificial Sequence
  Description of Artificial Sequence: Synthetic peptide
EPLELPAG

SEQ ID NO: 278 - protein, 8 aa, Artificial Sequence
  Description of Artificial Sequence: Synthetic peptide
EPLELAAG

SEQ ID NO: 279 - protein, 8 aa, Artificial Sequence
  Description of Artificial Sequence: Synthetic peptide
EPLELVAG

SEQ ID NO: 280 - protein, 8 aa, Artificial Sequence
  Description of Artificial Sequence: Synthetic peptide
EPLELSAG

SEQ ID NO: 281 - protein, 8 aa, Artificial Sequence
  Description of Artificial Sequence: Synthetic peptide
EPLELDAG

SEQ ID NO: 282 - protein, 8 aa, Artificial Sequence
  Description of Artificial Sequence: Synthetic peptide
EPLELQAG

SEQ ID NO: 283 - protein, 8 aa, Artificial Sequence
  Description of Artificial Sequence: Synthetic peptide
EPLELRAG

SEQ ID NO: 284 - protein, 8 aa, Artificial Sequence
  Description of Artificial Sequence: Synthetic peptide
EPLELKAG

SEQ ID NO: 285 - protein, 8 aa, Artificial Sequence
  Description of Artificial Sequence: Synthetic peptide
EPLELIAG

SEQ ID NO: 286 - protein, 8 aa, Artificial Sequence
  Description of Artificial Sequence: Synthetic peptide
LGPVSGVP

SEQ ID NO: 287 - protein, 8 aa, Artificial Sequence
  Description of Artificial Sequence: Synthetic peptide
VAGDSLEE

SEQ ID NO: 288 - protein, 8 aa, Artificial Sequence
  Description of Artificial Sequence: Synthetic peptide
GPAGLGGA

SEQ ID NO: 289 - protein, 8 aa, Artificial Sequence
  Description of Artificial Sequence: Synthetic peptide
GPAGLRGA

SEQ ID NO: 290 - protein, 8 aa, Artificial Sequence
  Description of Artificial Sequence: Synthetic peptide
APLGLRLR

SEQ ID NO: 291 - protein, 8 aa, Artificial Sequence
  Description of Artificial Sequence: Synthetic peptide
PALPLVAQ

SEQ ID NO: 292 - protein, 7 aa, Artificial Sequence
  Description of Artificial Sequence: Synthetic peptide
ENLYFQG

SEQ ID NO: 293 - protein, 8 aa, Artificial Sequence
  Description of Artificial Sequence: Synthetic peptide
DDDKIVGG

SEQ ID NO: 294 - protein, 8 aa, Artificial Sequence
  Description of Artificial Sequence: Synthetic peptide
LEVLFQGP

SEQ ID NO: 295 - protein, 8 aa, Artificial Sequence
  Description of Artificial Sequence: Synthetic peptide
LPKTGSES

SEQ ID NO: 296 - protein, 5 aa, Artificial Sequence
  Description of Artificial Sequence: Synthetic peptide
SGRSA

SEQ ID NO: 297 - protein, 5 aa, Artificial Sequence
  Description of Artificial Sequence: Synthetic peptide
YGRSA

SEQ ID NO: 298 - protein, 6 aa, Artificial Sequence
  Description of Artificial Sequence: Synthetic peptide
SSYYSG

SEQ ID NO: 299 - protein, 8 aa, Artificial Sequence
  Description of Artificial Sequence: Synthetic peptide
RRARVVGG

SEQ ID NO: 300 - protein, 8 aa, Artificial Sequence
  Description of Artificial Sequence: Synthetic peptide
RQLRVVGG

SEQ ID NO: 301 - protein, 8 aa, Artificial Sequence
  Description of Artificial Sequence: Synthetic peptide
RQARVVGG

SEQ ID NO: 302 - protein, 4 aa, Artificial Sequence
  Description of Artificial Sequence: Synthetic peptide
GFFY

SEQ ID NO: 303 - protein, 6 aa, Artificial Sequence
  Description of Artificial Sequence: Synthetic peptide
  MOD_RES (4)..(4): Homophenylalanine
  MOD_RES (5)..(5): Orn
PLGXXL

SEQ ID NO: 304 - protein, 7 aa, Artificial Sequence
  Description of Artificial Sequence: Synthetic peptide
  MOD_RES (3)..(3): Citrulline
  MOD_RES (5)..(5): Homophenylalanine
EPXFXYL

SEQ ID NO: 305 - protein, 7 aa, Artificial Sequence
  Description of Artificial Sequence: Synthetic peptide
PQGIAGQ

SEQ ID NO: 306 - protein, 6 aa, Artificial Sequence
  Description of Artificial Sequence: Synthetic peptide
  MOD_RES (5)..(5): Melphalan
PQGIXG

SEQ ID NO: 307 - protein, 6 aa, Artificial Sequence
  Description of Artificial Sequence: Synthetic peptide
  MOD_RES (5)..(5): Aminosuberic acid
AALGXP

SEQ ID NO: 308 - protein, 9 aa, Artificial Sequence
  Description of Artificial Sequence: Synthetic peptide
GPQGIAGQR

SEQ ID NO: 309 - protein, 10 aa, Artificial Sequence
  Description of Artificial Sequence: Synthetic peptide
SGKIPRTATA

SEQ ID NO: 310 - protein, 10 aa, Artificial Sequence
  Description of Artificial Sequence: Synthetic peptide
SGPLFYSVTA

SEQ ID NO: 311 - protein, 6 aa, Artificial Sequence
  Description of Artificial Sequence: Synthetic peptide
PLRLSW

SEQ ID NO: 312 - protein, 9 aa, Artificial Sequence
  Description of Artificial Sequence: Synthetic peptide
GKGPRQITA

SEQ ID NO: 313 - protein, 9 aa, Artificial Sequence
  Description of Artificial Sequence: Synthetic peptide
SGRRLIHHT

SEQ ID NO: 314 - protein, 10 aa, Artificial Sequence
  Description of Artificial Sequence: Synthetic peptide
SGQPHYLTTA

SEQ ID NO: 315 - protein, 7 aa, Artificial Sequence
  Description of Artificial Sequence: Synthetic peptide
SGLKALM

SEQ ID NO: 316 - protein, 10 aa, Artificial Sequence
  Description of Artificial Sequence: Synthetic peptide
SGFGSRYLTA

SEQ ID NO: 317 - protein, 10 aa, Artificial Sequence
  Description of Artificial Sequence: Synthetic peptide
SGLRPAKSTA

SEQ ID NO: 318 - protein, 7 aa, Artificial Sequence
  Description of Artificial Sequence: Synthetic peptide
LGPSTST

SEQ ID NO: 319 - protein, 5 aa, Artificial Sequence
  Description of Artificial Sequence: Synthetic peptide
PQGVR

SEQ ID NO: 320 - protein, 5 aa, Artificial Sequence
  Description of Artificial Sequence: Synthetic peptide
PSGLP

SEQ ID NO: 321 - protein, 5 aa, Artificial Sequence
  Description of Artificial Sequence: Synthetic peptide
PAGVQ

SEQ ID NO: 322 - protein, 5 aa, Artificial Sequence
  Description of Artificial Sequence: Synthetic peptide
PSGRD

SEQ ID NO: 323 - protein, 5 aa, Artificial Sequence
  Description of Artificial Sequence: Synthetic peptide
PPGIV

SEQ ID NO: 324 - protein, 5 aa, Artificial Sequence
  Description of Artificial Sequence: Synthetic peptide
PENFF

SEQ ID NO: 325 - protein, 5 aa, Artificial Sequence
  Description of Artificial Sequence: Synthetic peptide
PLKLM

SEQ ID NO: 326 - protein, 5 aa, Artificial Sequence
  Description of Artificial Sequence: Synthetic peptide
PGAYH

SEQ ID NO: 327 - protein, 5 aa, Artificial Sequence
  Description of Artificial Sequence: Synthetic peptide
AIHIQ

SEQ ID NO: 328 - protein, 5 aa, Artificial Sequence
  Description of Artificial Sequence: Synthetic peptide
HFFKN

SEQ ID NO: 329 - protein, 5 aa, Artificial Sequence
  Description of Artificial Sequence: Synthetic peptide
GLSLS

SEQ ID NO: 330 - protein, 5 aa, Artificial Sequence
  Description of Artificial Sequence: Synthetic peptide
ASDYK

SEQ ID NO: 331 - protein, 8 aa, Artificial Sequence
  Description of Artificial Sequence: Synthetic peptide
GPLGMLSQ

SEQ ID NO: 332 - protein, 5 aa, Artificial Sequence
  Description of Artificial Sequence: Synthetic peptide
CGLDD

SEQ ID NO: 333 - protein, 8 aa, Artificial Sequence
  Description of Artificial Sequence: Synthetic peptide
GPQGIWGQ

SEQ ID NO: 334 - protein, 8 aa, Artificial Sequence
  Description of Artificial Sequence: Synthetic peptide
RPLALWRS

SEQ ID NO: 335 - protein, 8 aa, Artificial Sequence
  Description of Artificial Sequence: Synthetic peptide
GPLGLARK

SEQ ID NO: 336 - protein, 7 aa, Artificial Sequence
  Description of Artificial Sequence: Synthetic peptide
GKAFRRL

SEQ ID NO: 337 - protein, 8 aa, Artificial Sequence
  Description of Artificial Sequence: Synthetic peptide
RPSASRSA

SEQ ID NO: 338 - protein, 7 aa, Artificial Sequence
  Description of Artificial Sequence: Synthetic peptide
  MOD_RES (5)..(5): D-phenylalanine
PLGLXAR

SEQ ID NO: 339 - protein, 6 aa, Artificial Sequence
  Description of Artificial Sequence: Synthetic peptide
PMGIST

SEQ ID NO: 340 - protein, 6 aa, Artificial Sequence
  Description of Artificial Sequence: Synthetic peptide
  MOD_RES (2)..(2): Beta-cyclohexylalanine
  MOD_RES (4)..(4): S-methylcysteine
PXGXHA

SEQ ID NO: 341 - protein, 7 aa, Artificial Sequence
  Description of Artificial Sequence: Synthetic peptide
  MOD_RES (2)..(2): Beta-cyclohexylalanine
  MOD_RES (4)..(4): Aminosuberic acid
  MOD_RES (7)..(7): D-phenylalanine
PXGXHAX

SEQ ID NO: 342 - protein, 8 aa, Artificial Sequence
  Description of Artificial Sequence: Synthetic peptide
PTASALKG

SEQ ID NO: 343 - protein, 9 aa, Artificial Sequence
  Description of Artificial Sequence: Synthetic peptide
PRPAAVKGT

SEQ ID NO: 344 - protein, 4 aa, Artificial Sequence
  Description of Artificial Sequence: Synthetic peptide
AAPV

SEQ ID NO: 345 - protein, 8 aa, Artificial Sequence
  Description of Artificial Sequence: Synthetic peptide
GPICFRLG

SEQ ID NO: 346 - protein, 4 aa, Artificial Sequence
  Description of Artificial Sequence: Synthetic peptide
AANL

SEQ ID NO: 347 - protein, 5 aa, Artificial Sequence
  Description of Artificial Sequence: Synthetic peptide
FSPFR

SEQ ID NO: 348 - protein, 5 aa, Artificial Sequence
  Description of Artificial Sequence: Synthetic peptide
EEEAY

SEQ ID NO: 349 - protein, 4 aa, Artificial Sequence
  Description of Artificial Sequence: Synthetic peptide
  MOD_RES (1)..(1): Beta-Ala
AIAL

SEQ ID NO: 350 - protein, 8 aa, Artificial Sequence
  Description of Artificial Sequence: Synthetic peptide
EVQRKTGT

SEQ ID NO: 351 - protein, 13 aa, Artificial Sequence
  Description of Artificial Sequence: Synthetic peptide
DVQEFRGVTAVIR

SEQ ID NO: 352 - protein, 13 aa, Artificial Sequence
  Description of Artificial Sequence: Synthetic peptide
HNEFRQRETYMVF

SEQ ID NO: 353 - protein, 8 aa, Artificial Sequence
  Description of Artificial Sequence: Synthetic peptide
KEEEGLGS

SEQ ID NO: 354 - protein, 8 aa, Artificial Sequence
  Description of Artificial Sequence: Synthetic peptide
GELEGRGT

SEQ ID NO: 355 - protein, 10 aa, Artificial Sequence
  Description of Artificial Sequence: Synthetic peptide
NITEGEARGS

SEQ ID NO: 356 - protein, 8 aa, Artificial Sequence
  Description of Artificial Sequence: Synthetic peptide
TAQEAGEG

SEQ ID NO: 357 - protein, 8 aa, Artificial Sequence
  Description of Artificial Sequence: Synthetic peptide
VSQELGQR

SEQ ID NO: 358 - protein, 8 aa, Artificial Sequence
  Description of Artificial Sequence: Synthetic peptide
PTAQEAGE

SEQ ID NO: 359 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 360 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 361 - protein, 7 aa, Artificial Sequence
  Description of Artificial Sequence: Synthetic peptide
  MOD_RES (7)..(7): Gly or Ser
ENLYFQX

SEQ ID NO: 362 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 363 - protein, 6 aa, Artificial Sequence
  Description of Artificial Sequence: Synthetic peptide
SASRSA

SEQ ID NO: 364 - protein, 5 aa, Artificial Sequence
  Description of Artificial Sequence: Synthetic peptide
  MOD_RES (4)..(4): Ser, Arg, Lys or Ala
  MOD_RES (5)..(5): Ala, Gly, Ser, Val or Arg
SGRXX

SEQ ID NO: 365 - protein, 6 aa, Artificial Sequence
  Description of Artificial Sequence: Synthetic peptide
  MOD_RES (3)..(3): Phe or Tyr
SSXYSG

SEQ ID NO: 366 - protein, 8 aa, Artificial Sequence
  Description of Artificial Sequence: Synthetic peptide
  MOD_RES (2)..(2): Arg, Ala or Leu
  MOD_RES (3)..(3): Ala, Leu or Tyr
  MOD_RES (5)..(5): Ala or Val
RXXRXVGG

SEQ ID NO: 367 - protein, 8 aa, Artificial Sequence
  Description of Artificial Sequence: Synthetic peptide
  MOD_RES (2)..(2): Arg or Gln
  MOD_RES (3)..(3): Tyr or Leu
RXXRVVGG

SEQ ID NO: 368 - protein, 8 aa, Artificial Sequence
  Description of Artificial Sequence: Synthetic peptide
  MOD_RES (5)..(5): Ala or Val
RRARXVGG

SEQ ID NO: 369 - protein, 8 aa, Artificial Sequence
  Description of Artificial Sequence: Synthetic peptide
  MOD_RES (2)..(2): Gln or Arg
  MOD_RES (5)..(5): Ala, Val or Tyr
RXARXVGG

SEQ ID NO: 370 - protein, 10 aa, Artificial Sequence
  Description of Artificial Sequence: Synthetic peptide
  MOD_RES (7)..(7): Pro, Ser, Thr, Arg or Ala
  MOD_RES (8)..(8): Any hydrophobic L-amino acid
  MOD_RES (9)..(9): Ser or Thr
SGKIPRXXXA

SEQ ID NO: 371 - protein, 9 aa, Artificial Sequence
  Description of Artificial Sequence: Synthetic peptide
  MOD_RES (6)..(6): Ile or Leu
SGRRLXHHT

SEQ ID NO: 372 - protein, 5 aa, Artificial Sequence
  Description of Artificial Sequence: Synthetic peptide
  MOD_RES (5)..(5): Pro or any hydrophobic L-amino acid
PSGLX

SEQ ID NO: 373 - protein, 8 aa, Artificial Sequence
  Description of Artificial Sequence: Synthetic peptide
  MOD_RES (4)..(4): Ala or Ser
  MOD_RES (6)..(6): Leu, Phe, Tyr or Gln
  MOD_RES (7)..(7): Lys, Arg, Thr or Ile
  MOD_RES (8)..(8): Gly, Ala or Ser
PTAXAXXX

SEQ ID NO: 374 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 375 - protein, 144 aa, Artificial Sequence
  Description of Artificial Sequence: Synthetic polypeptide
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 376 - protein, 144 aa, Artificial Sequence
  Description of Artificial Sequence: Synthetic polypeptide
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 377 - protein, 144 aa, Artificial Sequence
  Description of Artificial Sequence: Synthetic polypeptide
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 378 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 379 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 380 - protein, 144 aa, Artificial Sequence
  Description of Artificial Sequence: Synthetic polypeptide
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 381 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 382 - protein, 288 aa, Artificial Sequence
  Description of Artificial Sequence: Synthetic polypeptide
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 383 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 384 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 385 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 386 - protein, 865 aa, Artificial Sequence
  Description of Artificial Sequence: Synthetic polypeptide
GGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 387 - protein, 866 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 388 - protein, 1152 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 389 - protein, 144 aa, Artificial Sequence
  Description of Artificial Sequence: Synthetic polypeptide
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 390 - protein, 144 aa, Artificial Sequence
  Description of Artificial Sequence: Synthetic polypeptide
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 391 - protein, 180 aa, Artificial Sequence
  Description of Artificial Sequence: Synthetic polypeptide
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 392 - protein, 216 aa, Artificial Sequence
  Description of Artificial Sequence: Synthetic polypeptide
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 393 - protein, 252 aa, Artificial Sequence
  Description of Artificial Sequence: Synthetic polypeptide
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 394 - protein, 288 aa, Artificial Sequence
  Description of Artificial Sequence: Synthetic polypeptide
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 395 - protein, 324 aa, Artificial Sequence
  Description of Artificial Sequence: Synthetic polypeptide
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 396 - protein, 360 aa, Artificial Sequence
  Description of Artificial Sequence: Synthetic polypeptide
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 397 - protein, 360 aa, Artificial Sequence
  Description of Artificial Sequence: Synthetic polypeptide
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 398 - protein, 432 aa, Artificial Sequence
  Description of Artificial Sequence: Synthetic polypeptide
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 399 - protein, 468 aa, Artificial Sequence
  Description of Artificial Sequence: Synthetic polypeptide
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 400 - protein, 504 aa, Artificial Sequence
  Description of Artificial Sequence: Synthetic polypeptide
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 401 - protein, 540 aa, Artificial Sequence
  Description of Artificial Sequence: Synthetic polypeptide
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 402 - protein, 576 aa, Artificial Sequence
  Description of Artificial Sequence: Synthetic polypeptide
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 403 - protein, 612 aa, Artificial Sequence
  Description of Artificial Sequence: Synthetic polypeptide
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 404 - protein, 648 aa, Artificial Sequence
  Description of Artificial Sequence: Synthetic polypeptide
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 405 - protein, 684 aa, Artificial Sequence
  Description of Artificial Sequence: Synthetic polypeptide
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 406 - protein, 720 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 407 - protein, 756 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 408 - protein, 792 aa, Artificial Sequence
  Description of Artificial Sequence: Synthetic polypeptide
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 409 - protein, 828 aa, Artificial Sequence
  Description of Artificial Sequence: Synthetic polypeptide
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 410 - protein, 869 aa, Artificial Sequence
  Description of Artificial Sequence: Synthetic polypeptide
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGR

SEQ ID NO: 411 - protein, 144 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASR

SEQ ID NO: 412 - protein, 288 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 413 - protein, 432 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASR

SEQ ID NO: 414 - protein, 576 aa, Artificial Sequence
  Description of Artificial Sequence: Synthetic polypeptide
SAGSPTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 415 - protein, 864 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 416 - protein, 712 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEAHHH

SEQ ID NO: 417 - protein, 864 aa, Artificial Sequence
  Description of Artificial Sequence: Synthetic polypeptide
GSPGAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 418 - protein, 12 aa, Artificial Sequence
  Description of Artificial Sequence: Synthetic peptide
GESPGGSSGSES

SEQ ID NO: 419 - protein, 12 aa, Artificial Sequence
  Description of Artificial Sequence: Synthetic peptide
GSEGSSGPGESS

SEQ ID NO: 420 - protein, 12 aa, Artificial Sequence
  Description of Artificial Sequence: Synthetic peptide
GSSESGSSEGGP

SEQ ID NO: 421 - protein, 12 aa, Artificial Sequence
  Description of Artificial Sequence: Synthetic peptide
GSGGEPSESGSS

SEQ ID NO: 422 - protein, 12 aa, Artificial Sequence
  Description of Artificial Sequence: Synthetic peptide
GSPAGSPTSTEE

SEQ ID NO: 423 - protein, 12 aa, Artificial Sequence
  Description of Artificial Sequence: Synthetic peptide
GSEPATSGSETP

SEQ ID NO: 424 - protein, 12 aa, Artificial Sequence
  Description of Artificial Sequence: Synthetic peptide
GTSESATPESGP

SEQ ID NO: 425 - protein, 12 aa, Artificial Sequence
  Description of Artificial Sequence: Synthetic peptide
GTSTEPSEGSAP

SEQ ID NO: 426 - protein, 12 aa, Artificial Sequence
  Description of Artificial Sequence: Synthetic peptide
GSTSESPSGTAP

SEQ ID NO: 427 - protein, 12 aa, Artificial Sequence
  Description of Artificial Sequence: Synthetic peptide
GTSTPESGSASP

SEQ ID NO: 428 - protein, 12 aa, Artificial Sequence
  Description of Artificial Sequence: Synthetic peptide
GTSPSGESSTAP

SEQ ID NO: 429 - protein, 12 aa, Artificial Sequence
  Description of Artificial Sequence: Synthetic peptide
GSTSSTAESPGP

SEQ ID NO: 430 - protein, 1157 aa, Artificial Sequence
  Description of Artificial Sequence: Synthetic polypeptide
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 431 - protein, 1157 aa, Artificial Sequence
  Description of Artificial Sequence: Synthetic polypeptide
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHVPLSLKMGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 432 - protein, 1157 aa, Artificial Sequence
  Description of Artificial Sequence: Synthetic polypeptide
EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGATPPETGAETESPGETTGGSAESEPPGEGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 433 - protein, 1157 aa, Artificial Sequence
  Description of Artificial Sequence: Synthetic polypeptide
EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGATPPETGAETESPGETTGGSAESEPPGEGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGTAEAASASGLSGRSDNHVPLSLKMGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 434 - protein, 1162 aa, Artificial Sequence
  Description of Artificial Sequence: Synthetic polypeptide
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 435 - protein, 1162 aa, Artificial Sequence
  Description of Artificial Sequence: Synthetic polypeptide
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHVPLSLKMGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 436 - protein, 1162 aa, Artificial Sequence
  Description of Artificial Sequence: Synthetic polypeptide
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGATPPETGAETESPGETTGGSAESEPPGEGELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 437 - protein, 1162 aa, Artificial Sequence
  Description of Artificial Sequence: Synthetic polypeptide
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGATPPETGAETESPGETTGGSAESEPPGEGELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGTAEAASASGLSGRSDNHVPLSLKMGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 438 - protein, 1156 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHSPLGLAGSGTAEAASASGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSS

SEQ ID NO: 439 - protein, 1156 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHVPLSLKMGGTAEAASASGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSS

SEQ ID NO: 440 - protein, 1156 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHSPLGLAGSGTAEAASASGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGATPPETGAETESPGETTGGSAESEPPGEGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIK

SEQ ID NO: 441 - protein, 1156 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHVPLSLKMGGTAEAASASGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGATPPETGAETESPGETTGGSAESEPPGEGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIK

SEQ ID NO: 442 - protein, 1161 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHSPLGLAGSGTAEAASASGELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 443 - protein, 1161 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHVPLSLKMGGTAEAASASGELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 444 - protein, 1161 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHSPLGLAGSGTAEAASASGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGATPPETGAETESPGETTGGSAESEPPGEGELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 445 - protein, 1161 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHVPLSLKMGGTAEAASASGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGATPPETGAETESPGETTGGSAESEPPGEGELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 446 - DNA, 3471 bp, Artificial Sequence
  Description of Artificial Sequence: Synthetic polynucleotide
gacatccaaatgacccagagcccgagcagcctgagcgcgagcgtgggcgaccgtgttaccatcacctgccgtgcgagccaagacatccgtaactacctgaactggtatcagcaaaagccgggtaaagcgccgaagctgctgatctactataccagccgtctggagagcggcgtgccgagccgtttcagcggtagcggtagcggtaccgactacaccctgaccattagcagcctgcagccggaagatttcgcgacctactattgccagcagggtaacaccctgccgtggacctttggtcaaggcaccaaagttgagattaaaggcgccacgcctccggaaactggtgctgagacggaatcccctggtgaaaccactggcggttctgccgaatctgaaccgcctggtgaaggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 447 - DNA, 3471 bp, Artificial Sequence
  Description of Artificial Sequence: Synthetic polynucleotide
gacatccaaatgacccagagcccgagcagcctgagcgcgagcgtgggcgaccgtgttaccatcacctgccgtgcgagccaagacatccgtaactacctgaactggtatcagcaaaagccgggtaaagcgccgaagctgctgatctactataccagccgtctggagagcggcgtgccgagccgtttcagcggtagcggtagcggtaccgactacaccctgaccattagcagcctgcagccggaagatttcgcgacctactattgccagcagggtaacaccctgccgtggacctttggtcaaggcaccaaagttgagattaaaggcgccacgcctccggaaactggtgctgagacggaatcccctggtgaaaccactggcggttctgccgaatctgaaccgcctggtgaaggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcaccgccgaagcagctagcgcctctggcctgtcaggtcgttctgataaccatgttccactgtctctgaaaatgggtccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 448 - DNA, 3471 bp, Artificial Sequence
  Description of Artificial Sequence: Synthetic polynucleotide
gaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcgccacgcctccggaaactggtgctgagacggaatcccctggtgaaaccactggcggttctgccgaatctgaaccgcctggtgaaggcgacatccaaatgacccagagcccgagcagcctgagcgcgagcgtgggcgaccgtgttaccatcacctgccgtgcgagccaagacatccgtaactacctgaactggtatcagcaaaagccgggtaaagcgccgaagctgctgatctactataccagccgtctggagagcggcgtgccgagccgtttcagcggtagcggtagcggtaccgactacaccctgaccattagcagcctgcagccggaagatttcgcgacctactattgccagcagggtaacaccctgccgtggacctttggtcaaggcaccaaagttgagattaaaggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 449 - DNA, 3471 bp, Artificial Sequence
  Description of Artificial Sequence: Synthetic polynucleotide
gaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcgccacgcctccggaaactggtgctgagacggaatcccctggtgaaaccactggcggttctgccgaatctgaaccgcctggtgaaggcgacatccaaatgacccagagcccgagcagcctgagcgcgagcgtgggcgaccgtgttaccatcacctgccgtgcgagccaagacatccgtaactacctgaactggtatcagcaaaagccgggtaaagcgccgaagctgctgatctactataccagccgtctggagagcggcgtgccgagccgtttcagcggtagcggtagcggtaccgactacaccctgaccattagcagcctgcagccggaagatttcgcgacctactattgccagcagggtaacaccctgccgtggacctttggtcaaggcaccaaagttgagattaaaggcaccgccgaagcagctagcgcctctggcctgtcaggtcgttctgataaccatgttccactgtctctgaaaatgggtccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 450 - DNA, 3486 bp, Artificial Sequence
  Description of Artificial Sequence: Synthetic polynucleotide
gaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctgggtgcgaccccgccggaaaccggtgcggaaaccgaaagcccgggtgaaaccaccggtggcagcgcggagagcgaaccgccgggtgaaggtgaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagcggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 451 - DNA, 3486 bp, Artificial Sequence
  Description of Artificial Sequence: Synthetic polynucleotide
gaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctgggtgcgaccccgccggaaaccggtgcggaaaccgaaagcccgggtgaaaccaccggtggcagcgcggagagcgaaccgccgggtgaaggtgaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagcggcaccgccgaagcagctagcgcctctggcctgtcaggtcgttctgataaccatgttccactgtctctgaaaatgggtccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 452 - DNA, 3486 bp, Artificial Sequence
  Description of Artificial Sequence: Synthetic polynucleotide
gaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagcggtgcgaccccgccggaaaccggtgcggaaaccgaaagcccgggtgaaaccaccggtggcagcgcggagagcgaaccgccgggtgaaggtgaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctgggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 453 - DNA, 3486 bp, Artificial Sequence
  Description of Artificial Sequence: Synthetic polynucleotide
gaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagcggtgcgaccccgccggaaaccggtgcggaaaccgaaagcccgggtgaaaccaccggtggcagcgcggagagcgaaccgccgggtgaaggtgaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctgggcaccgccgaagcagctagcgcctctggcctgtcaggtcgttctgataaccatgttccactgtctctgaaaatgggtccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 454 - DNA, 3468 bp, Artificial Sequence
  Description of Artificial Sequence: Synthetic polynucleotide
catcaccaccatcatcacggaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccactgtcaggtcgttctgataaccattccccactgggtctggctgggtctggcaccgccgaagcagctagcgcctctggcgacatccaaatgacccaatcaccgtcatccctgagcgcctctgttggagatcgtgtaacaattacctgccgcgcctcccaagacatccgcaattacttaaactggtatcagcaaaaacccggtaaggcaccgaaattgctgatttattatacttcacgcttagagagtggggtgccgtcgcgcttcagtggctcgggtagtgggaccgattacacattgacaatttcatcactgcagccagaggattttgcgacttattactgtcaacagggtaacacgcttccctggaccttcgggcaaggcacgaaagttgagatcaagggcgctactccccctgagacaggagcggaaacggaatcccctggcgagacgacgggtggttccgcagagtcggaacctcctggtgagggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctcc

SEQ ID NO: 455 - DNA, 3468 bp, Artificial Sequence
  Description of Artificial Sequence: Synthetic polynucleotide
catcaccaccatcatcacggaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccactgtcaggtcgttctgataaccatgttccactgtctctgaaaatgggtggcaccgccgaagcagctagcgcctctggcgacatccaaatgacccaatcaccgtcatccctgagcgcctctgttggagatcgtgtaacaattacctgccgcgcctcccaagacatccgcaattacttaaactggtatcagcaaaaacccggtaaggcaccgaaattgctgatttattatacttcacgcttagagagtggggtgccgtcgcgcttcagtggctcgggtagtgggaccgattacacattgacaatttcatcactgcagccagaggattttgcgacttattactgtcaacagggtaacacgcttccctggaccttcgggcaaggcacgaaagttgagatcaagggcgctactccccctgagacaggagcggaaacggaatcccctggcgagacgacgggtggttccgcagagtcggaacctcctggtgagggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctcc

SEQ ID NO: 456 - DNA, 3468 bp, Artificial Sequence
  Description of Artificial Sequence: Synthetic polynucleotide
catcaccaccatcatcacggaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccactgtcaggtcgttctgataaccattccccactgggtctggctgggtctggcaccgccgaagcagctagcgcctctggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcgctactccccctgagacaggagcggaaacggaatcccctggcgagacgacgggtggttccgcagagtcggaacctcctggtgagggcgacatccaaatgacccaatcaccgtcatccctgagcgcctctgttggagatcgtgtaacaattacctgccgcgcctcccaagacatccgcaattacttaaactggtatcagcaaaaacccggtaaggcaccgaaattgctgatttattatacttcacgcttagagagtggggtgccgtcgcgcttcagtggctcgggtagtgggaccgattacacattgacaatttcatcactgcagccagaggattttgcgacttattactgtcaacagggtaacacgcttccctggaccttcgggcaaggcacgaaagttgagatcaag

SEQ ID NO: 457 - DNA, 3468 bp, Artificial Sequence
  Description of Artificial Sequence: Synthetic polynucleotide
catcaccaccatcatcacggaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccactgtcaggtcgttctgataaccatgttccactgtctctgaaaatgggtggcaccgccgaagcagctagcgcctctggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcgctactccccctgagacaggagcggaaacggaatcccctggcgagacgacgggtggttccgcagagtcggaacctcctggtgagggcgacatccaaatgacccaatcaccgtcatccctgagcgcctctgttggagatcgtgtaacaattacctgccgcgcctcccaagacatccgcaattacttaaactggtatcagcaaaaacccggtaaggcaccgaaattgctgatttattatacttcacgcttagagagtggggtgccgtcgcgcttcagtggctcgggtagtgggaccgattacacattgacaatttcatcactgcagccagaggattttgcgacttattactgtcaacagggtaacacgcttccctggaccttcgggcaaggcacgaaagttgagatcaag

SEQ ID NO: 458 - DNA, 3483 bp, Artificial Sequence
  Description of Artificial Sequence: Synthetic polynucleotide
catcaccaccatcatcacggaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccactgtcaggtcgttctgataaccattccccactgggtctggctgggtctggcaccgccgaagcagctagcgcctctggcgaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctgggtgcgaccccgccggaaaccggtgcggaaaccgaaagcccgggtgaaaccaccggtggcagcgcggagagcgaaccgccgggtgaaggtgaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagc

SEQ ID NO: 459 - DNA, 3483 bp, Artificial Sequence
  Description of Artificial Sequence: Synthetic polynucleotide
catcaccaccatcatcacggaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccactgtcaggtcgttctgataaccatgttccactgtctctgaaaatgggtggcaccgccgaagcagctagcgcctctggcgaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctgggtgcgaccccgccggaaaccggtgcggaaaccgaaagcccgggtgaaaccaccggtggcagcgcggagagcgaaccgccgggtgaaggtgaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagc

SEQ ID NO: 460 - DNA, 3483 bp, Artificial Sequence
  Description of Artificial Sequence: Synthetic polynucleotide
catcaccaccatcatcacggaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccactgtcaggtcgttctgataaccattccccactgggtctggctgggtctggcaccgccgaagcagctagcgcctctggcgaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagcggtgcgaccccgccggaaaccggtgcggaaaccgaaagcccgggtgaaaccaccggtggcagcgcggagagcgaaccgccgggtgaaggtgaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctg

SEQ ID NO: 461 - DNA, 3483 bp, Artificial Sequence
  Description of Artificial Sequence: Synthetic polynucleotide
catcaccaccatcatcacggaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccactgtcaggtcgttctgataaccatgttccactgtctctgaaaatgggtggcaccgccgaagcagctagcgcctctggcgaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagcggtgcgaccccgccggaaaccggtgcggaaaccgaaagcccgggtgaaaccaccggtggcagcgcggagagcgaaccgccgggtgaaggtgaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctg

SEQ ID NO: 462 - protein, 15 aa, Artificial Sequence
  Description of Artificial Sequence: Synthetic peptide
GGGGSGGGGSGGGGS

SEQ ID NO: 463 - protein, 18 aa, Artificial Sequence
  Description of Artificial Sequence: Synthetic peptide
GEGTSTGSGGSGGSGGAD

SEQ ID NO: 464 - protein, 18 aa, Artificial Sequence
  Description of Artificial Sequence: Synthetic peptide
VEGGSGGSGGSGGSGGVD

SEQ ID NO: 465 - protein, 29 aa, Artificial Sequence
  Description of Artificial Sequence: Synthetic peptide
RTSGPGDGGKGGPGKGPGGEGTKGTGPGG

SEQ ID NO: 466 - protein, 30 aa, Artificial Sequence
  Description of Artificial Sequence: Synthetic polypeptide
GSGEGSEGEGGGEGSEGEGSGEGGEGEGSG

SEQ ID NO: 467 - protein, 32 aa, Artificial Sequence
  Description of Artificial Sequence: Synthetic polypeptide
TGSGEGSEGEGGGEGSEGEGSGEGGEGEGSGT

SEQ ID NO: 468 - protein, 30 aa, Artificial Sequence
  Description of Artificial Sequence: Synthetic polypeptide
GATPPETGAETESPGETTGGSAESEPPGEG

SEQ ID NO: 469 - protein, 30 aa, Artificial Sequence
  Description of Artificial Sequence: Synthetic polypeptide
GSAAPTAGTTPSASPAPPTGGSSAAGSPST

SEQ ID NO: 470 - protein, 30 aa, Artificial Sequence
  Description of Artificial Sequence: Synthetic polypeptide
GEGGESGGSEGEGSGEGEGGSGGEGESEGG

SEQ ID NO: 471 - protein, 30 aa, Artificial Sequence
  Description of Artificial Sequence: Synthetic polypeptide
STETSPSTPTESPEAGSGSGSPESPSGTEA

SEQ ID NO: 472 - protein, 30 aa, Artificial Sequence
  Description of Artificial Sequence: Synthetic polypeptide
PTGTTGEPSGEGSEPEGSAPTSSTSEATPS

SEQ ID NO: 473 - protein, 30 aa, Artificial Sequence
  Description of Artificial Sequence: Synthetic polypeptide
SESESEGEAPTGPGASTTPEPSESPTPETS

SEQ ID NO: 474 - protein, 30 aa, Artificial Sequence
  Description of Artificial Sequence: Synthetic polypeptide
PEGGESGEGTGPGTGGEPEGEGGPGGEGGT

SEQ ID NO: 475 - protein, 6 aa, Artificial Sequence
  Description of Artificial Sequence: Synthetic peptide
SGGGGS

SEQ ID NO: 476 - protein, 5 aa, Artificial Sequence
  Description of Artificial Sequence: Synthetic peptide
GGGGS

SEQ ID NO: 477 - DNA, 4257 bp, Artificial Sequence
  Description of Artificial Sequence: Synthetic polynucleotide
atgaagaaaaacatcgcttttcttcttgcatctatgttcgttttttctattgctacaaacgcgtacgctcatcaccaccatcatcaccatcacgaactggttatgacccaaagcccgagcagcctgaccgttaccgcgggcgaaaaggttaccatgagctgcaaaagcagccaaagcctgctgaacagcggcaaccaaaagaactacctgacctggtaccaacagaagccgggtcagccgccgaaactgctgatctactgggcgagcacccgtgagagcggcgttccggaccgttttaccggcagcggcagcggtaccgactttaccctgaccattagcagcgtgcaggcggaagatctggcggtgtactattgccaaaacgactacagctacccgctgacctttggtgcgggcaccaaactggagatcaagggtggcggtggcagcggcggtggtggcagcggcggcggtggcagcgaggttcagctgctggaacagagcggcgcggagctggtgcgtccgggtaccagcgttaagatcagctgcaaggcgagcggttatgcgttcaccaactactggctgggttgggtgaagcaacgtccgggtcacggtctggagtggatcggcgacattttcccgggcagcggtaacatccactacaacgagaaattcaagggtaaagcgaccctgaccgcggataaaagcagcagcaccgcgtatatgcagctgagcagcctgaccttcgaagatagcgcggtttacttctgcgcgcgtctgcgtaactgggatgaaccgatggattactggggtcagggcaccaccgtgaccgttagcagcggtggtggcggcagcgatgttcagctggtgcaaagcggtgcggaagtgaaaaagccgggtgcgagcgtgaaagttagctgcaaagcgagcggctataccttcacccgttacaccatgcactgggttcgtcaggcgccgggtcagggcctggaatggatcggctacatcaacccgagccgtggctataccaactacgcggatagcgtgaaaggtcgtttcaccattaccaccgacaaaagcaccagcaccgcgtacatggaactgagcagcctgcgtagcgaggataccgcgacctactattgcgcgcgttactatgatgaccactactgcctggactattggggccaaggtaccaccgttaccgtgagcagcggtgaaggcaccagcaccggcagcggtggtagcggtggtagcggcggtgcggatgacatcgttctgacccaaagcccggcgaccctgagcctgagcccgggcgagcgtgcgaccctgagctgccgtgcgagccagagcgttagctacatgaactggtaccagcaaaagccgggcaaagcgccgaagcgttggatttatgataccagcaaggttgcgagcggtgttccggcgcgtttcagcggtagcggtagcggcaccgattatagcctgaccattaacagcctggaggcggaagatgcggcgacctactactgccaacaatggagcagcaatccgctgaccttcggtggtggtaccaaagttgaaattaagggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggt

SEQ ID NO: 478 - DNA, 4329 bp, Artificial Sequence
  Description of Artificial Sequence: Synthetic polynucleotide
atgaagaaaaacatcgcttttcttcttgcatctatgttcgttttttctattgctacaaacgcgtacgctgatattcagatgacccaatcgccgtcgtccctgtcagcttcagtcggtgatcgtgttaccattacctgtcgctcaacgaaatccctgctgcattcaaacggtattacctatctgtactggtatcagcaaaaaccgggcaaagcgccgaaactgctgatctaccagatgtcgaatctggccagcggtgttccgtctcgttttagctctagtggttctggcaccgatttcaccctgacgatttcctcactgcaaccggaagactttgcaacgtattactgcgctcagaacctggaaatcccgcgtaccttcggtcaaggcacgaaagtcgaaattaaaggtgcaacgcctccggagactggtgctgaaactgagtccccgggcgagacgaccggtggctctgctgaatccgaaccaccgggcgaaggccaagtgcaactggttcagagcggtccgggtctggtccaaccgggtggcagtgtgcgtatttcctgcgcggcctcaggttacacctttacgaactatggcatgaattgggtgaaacaggccccgggtaaaggcctggaatggatgggttggatcaacacctacacgggcgaatctacctatgcagatagtttcaaaggccgctttaccttcagcctggacacgtctgctagtgcagcttatctgcagattaatagcctgcgtgcggaagatacggccgtttattactgtgcgcgctttgcaatcaaaggcgactactggggccaaggcaccctgctgaccgtgtcctccggtggtggcggcagcgacatccaaatgacccagagcccgagcagcctgagcgcgagcgtgggcgaccgtgttaccatcacctgccgtgcgagccaagacatccgtaactacctgaactggtatcagcaaaagccgggtaaagcgccgaagctgctgatctactataccagccgtctggagagcggcgtgccgagccgtttcagcggtagcggtagcggtaccgactacaccctgaccattagcagcctgcagccggaagatttcgcgacctactattgccagcagggtaacaccctgccgtggacctttggtcaaggcaccaaagttgagattaaaggcgccacgcctccggaaactggtgctgagacggaatcccctggtgaaaccactggcggttctgccgaatctgaaccgcctggtgaaggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 479 - protein, 1419 aa, Artificial Sequence
  Description of Artificial Sequence: Synthetic polypeptide
MKKNIAFLLASMFVFSIATNAYAHHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 480 - protein, 1443 aa, Artificial Sequence
  Description of Artificial Sequence: Synthetic polypeptide
MKKNIAFLLASMFVFSIATNAYADIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 481 - protein, 8 aa, Artificial Sequence
  Description of Artificial Sequence: Synthetic 8xHis tag
HHHHHHHH

SEQ ID NO: 482 - protein, 31 aa, Artificial Sequence
  Description of Artificial Sequence: Synthetic polypeptide
MKKNIAFLLASMFVFSIATNAYAHHHHHHHH

SEQ ID NO: 483 - protein, 6 aa, Artificial Sequence
  Description of Artificial Sequence: Synthetic 6xHis tag
HHHHHH

SEQ ID NO: 484 - protein, 23 aa, Artificial Sequence
  Description of Artificial Sequence: Synthetic peptide
MKKNIAFLLASMFVFSIATNAYA

SEQ ID NO: 485 - protein, 1398 aa, Artificial Sequence
  Description of Artificial Sequence: Synthetic polypeptide
HHHHHHHHDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 486 - protein, 1396 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 487 - protein, 1386 aa, Artificial Sequence
  Description of Artificial Sequence: Synthetic polypeptide
HHHHHHHHEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 488 - protein, 1380 aa, Artificial Sequence
  Description of Artificial Sequence: Synthetic polypeptide
HHHHHHHHDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 489 - protein, 1372 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 490 - protein, 1411 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTSGPGDGGKGGPGKGPGGEGTKGTGPGGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 491 - protein, 1411 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSRTSGPGDGGKGGPGKGPGGEGTKGTGPGGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 492 - protein, 1423 aa, Artificial Sequence
  Description of Artificial Sequence: Synthetic polypeptide
HHHHHHHHGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGLSGRSDNHSPLGLAGSGTAEAASASGELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 493 - protein, 1398 aa, Artificial Sequence
  Description of Artificial Sequence: Synthetic polypeptide
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGLSGRSDNHSPLGLAGSGTAEAASASGELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHH

SEQ ID NO: 494 - protein, 1396 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 495 - protein, 1396 aa, Artificial Sequence
  Description of Artificial Sequence: Synthetic polypeptide
HHHHHHHHEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 496 - protein, 1396 aa, Artificial Sequence
  Description of Artificial Sequence: Synthetic polypeptide
HHHHHHHHDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 497 - protein, 1396 aa, Artificial Sequence
  Description of Artificial Sequence: Synthetic polypeptide
HHHHHHHHDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 498 - protein, 1420 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 499 - protein, 1396 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 500 - protein, 1425 aa, Artificial Sequence
  Description of Artificial Sequence: Synthetic polypeptide
DIVMTQSPLSLPVTPGEPASISCRSSKNLLHSNGITYLYWYLQKPGQSPQLLIYQMSNLASGVPDRFSSSGSGTDFTLKISRVEAEDVGVYYCAQNLEIPRTFGQGTKVEIKGATPPETGAETESPGETTGGSAESEPPGEGQVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 501 - protein, 1401 aa, Artificial Sequence
  Description of Artificial Sequence: Synthetic polypeptide
DIVMTQSPLSLPVTPGEPASISCRSSKNLLHSNGITYLYWYLQKPGQSPQLLIYQMSNLASGVPDRFSSSGSGTDFTLKISRVEAEDVGVYYCAQNLEIPRTFGQGTKVEIKGATPPETGAETESPGETTGGSAESEPPGEGQVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 502 - protein, 1419 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHSPLGLAGSGTAEAASASGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGGGGSDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 503 - protein, 1396 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGGGGSDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 504 - protein, 1419 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 505 - protein, 1395 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 506 - protein, 1424 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 507 - protein, 1400 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 508 - protein, 1418 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 509 - protein, 1394 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 510 - protein, 528 aa, Artificial Sequence
  Description of Artificial Sequence: Synthetic polypeptide
HHHHHHHHDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGTAEAASASGLSGRSDNHSPLG

SEQ ID NO: 511 - protein, 526 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLG

SEQ ID NO: 512 - protein, 516 aa, Artificial Sequence
  Description of Artificial Sequence: Synthetic polypeptide
HHHHHHHHEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGTAEAASASGLSGRSDNHSPLG

SEQ ID NO: 513 - protein, 510 aa, Artificial Sequence
  Description of Artificial Sequence: Synthetic polypeptide
HHHHHHHHDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLG

SEQ ID NO: 514 - protein, 541 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTSGPGDGGKGGPGKGPGGEGTKGTGPGGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLG

SEQ ID NO: 515 - protein, 541 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSRTSGPGDGGKGGPGKGPGGEGTKGTGPGGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGTAEAASASGLSGRSDNHSPLG

SEQ ID NO: 516 - protein, 532 aa, Artificial Sequence
  Description of Artificial Sequence: Synthetic polypeptide
LAGSGTAEAASASGELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLG

SEQ ID NO: 517 - protein, 518 aa, Artificial Sequence
  Description of Artificial Sequence: Synthetic polypeptide
LAGSGTAEAASASGELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHH

SEQ ID NO: 518 - protein, 526 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGTAEAASASGLSGRSDNHSPLG

SEQ ID NO: 519 - protein, 526 aa, Artificial Sequence
  Description of Artificial Sequence: Synthetic polypeptide
HHHHHHHHEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLG

SEQ ID NO: 520 - protein, 526 aa, Artificial Sequence
  Description of Artificial Sequence: Synthetic polypeptide
HHHHHHHHDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGTAEAASASGLSGRSDNHSPLG

SEQ ID NO: 521 - protein, 526 aa, Artificial Sequence
  Description of Artificial Sequence: Synthetic polypeptide
HHHHHHHHDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGTAEAASASGLSGRSDNHSPLG

SEQ ID NO: 522 - protein, 544 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLG

SEQ ID NO: 523 - protein, 549 aa, Artificial Sequence
  Description of Artificial Sequence: Synthetic polypeptide
DIVMTQSPLSLPVTPGEPASISCRSSKNLLHSNGITYLYWYLQKPGQSPQLLIYQMSNLASGVPDRFSSSGSGTDFTLKISRVEAEDVGVYYCAQNLEIPRTFGQGTKVEIKGATPPETGAETESPGETTGGSAESEPPGEGQVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLG

SEQ ID NO: 524 - protein, 536 aa, Artificial Sequence
  Description of Artificial Sequence: Synthetic polypeptide
LAGSGTAEAASASGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGGGGSDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 525 - protein, 543 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLG

SEQ ID NO: 526 - protein, 548 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLG

SEQ ID NO: 527 - protein, 542 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLG

SEQ ID NO: 528 - protein, 547 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLG

SEQ ID NO: 529 - protein, 541 aa, Artificial Sequence
  Description of Artificial Sequence: Synthetic polypeptide
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKGATPPETGAETESPGETTGGSAESEPPGEGEVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLG

SEQ ID NO: 530 - protein, 538 aa, Artificial Sequence
  Description of Artificial Sequence: Synthetic polypeptide
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGATPPETGAETESPGETTGGSAESEPPGEGEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLG

SEQ ID NO: 531 - DNA, 4260 bp, Artificial Sequence
  Description of Artificial Sequence: Synthetic polynucleotide
gatattcagatgacccaatcgccgtcgtccctgtcagcttcagtcggtgatcgtgttaccattacctgtcgctcaacgaaatccctgctgcattcaaacggtattacctatctgtactggtatcagcaaaaaccgggcaaagcgccgaaactgctgatctaccagatgtcgaatctggccagcggtgttccgtctcgttttagctctagtggttctggcaccgatttcaccctgacgatttcctcactgcaaccggaagactttgcaacgtattactgcgctcagaacctggaaatcccgcgtaccttcggtcaaggcacgaaagtcgaaattaaaggtgcaacgcctccggagactggtgctgaaactgagtccccgggcgagacgaccggtggctctgctgaatccgaaccaccgggcgaaggccaagtgcaactggttcagagcggtccgggtctggtccaaccgggtggcagtgtgcgtatttcctgcgcggcctcaggttacacctttacgaactatggcatgaattgggtgaaacaggccccgggtaaaggcctggaatggatgggttggatcaacacctacacgggcgaatctacctatgcagatagtttcaaaggccgctttaccttcagcctggacacgtctgctagtgcagcttatctgcagattaatagcctgcgtgcggaagatacggccgtttattactgtgcgcgctttgcaatcaaaggcgactactggggccaaggcaccctgctgaccgtgtcctccggtggtggcggcagcgacatccaaatgacccagagcccgagcagcctgagcgcgagcgtgggcgaccgtgttaccatcacctgccgtgcgagccaagacatccgtaactacctgaactggtatcagcaaaagccgggtaaagcgccgaagctgctgatctactataccagccgtctggagagcggcgtgccgagccgtttcagcggtagcggtagcggtaccgactacaccctgaccattagcagcctgcagccggaagatttcgcgacctactattgccagcagggtaacaccctgccgtggacctttggtcaaggcaccaaagttgagattaaaggcgccacgcctccggaaactggtgctgagacggaatcccctggtgaaaccactggcggttctgccgaatctgaaccgcctggtgaaggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 532 - DNA, 4260 bp, Artificial Sequence
  Description of Artificial Sequence: Synthetic polynucleotide
gatatccagatgacccagagcccttcttccctgtccgcatccgtcggcgatcgtgtcacgattacctgtcgcagcactaagagcctgctgcactcaaacggtatcacgtacctgtactggtaccagcagaagccgggcaaagcgccgaagctgctgatttatcagatgagcaacctggcatcgggcgtgccgagccgtttcagcagcagcggtagcggtaccgacttcacgctgaccatcagctcgttgcagccagaggactttgcgacgtactattgtgcgcaaaacttggaaattccgcgcaccttcggccagggtacgaaagttgagattaaaggtgccaccccaccggagactggtgcagaaaccgagtctccgggcgaaaccacgggcggtagcgcggagagcgaaccgcctggtgagggtcaagttcaattggttcagagcggtccgggtctggttcaaccgggcggcagcgtgcgcatttcttgtgcggccagcggttacacctttacgaactacggtatgaattgggtgaaacaagctccgggcaaaggtctggagtggatgggttggatcaatacctataccggtgaatccacttacgcggattcctttaagggccgtttcaccttcagcctggacacgagcgcgagcgctgcatatctgcaaatcaatagcctgcgtgccgaagataccgcggtgtactattgcgcgcgttttgcaatcaagggcgactattggggtcaaggcacgctgctgaccgtgagcagcggtggtggcggcagcgatatccaaatgacccaatccccatcctccctgtctgcaagcgttggtgatcgtgtgacgattacgtgccgtgcctcccaagatatccgtaactacctgaattggtatcagcagaaaccgggcaaggctccgaaattgctgatctactacaccagccgcctggagtcgggtgtgcctagccgcttcagcggcagcggttcgggtaccgactataccttgaccattagcagcctgcagccggaagatttcgcgacgtattactgccaacagggtaacacgctgccgtggacctttggccaaggtaccaaagtcgagattaagggtgcgaccccgccggaaaccggtgcggaaaccgagagcccgggtgaaacgactggcggctctgcagagagcgagccgccaggtgagggcgaagtccaactggtcgagtctggtggcggcctggtgcaaccgggtggcagcctgcgtctgagctgcgctgcgagcggctatagctttaccggttataccatgaactgggttcgccaggcaccgggtaagggtctggaatgggtggcgctgatcaatccgtacaaaggtgtgagcacttacaatcagaaattcaaagaccgtttcaccattagcgttgacaagagcaagaataccgcgtatctgcagatgaacagcttgcgcgccgaggatacggccgtttactactgtgcacgtagcggctattacggtgacagcgactggtactttgacgtctggggtcagggcacgctggtcaccgttagcagcggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 533 - protein, 1420 aa, Artificial Sequence; identical to SEQ ID NO: 498
  Description of Artificial Sequence: Synthetic polypeptide

SEQ ID NO: 534 - protein, 1425 aa, Artificial Sequence; identical to SEQ ID NO: 500
  Description of Artificial Sequence: Synthetic polypeptide

What is claimed is:

1. A chimeric polypeptide assembly comprising a first portion, a second portion, and a third portion wherein:
   a. the first portion comprises:
      i. a first binding domain with binding specificity to a target cell marker; and
      ii. a second binding domain with binding specificity to an effector cell antigen;
   b. the second portion comprises a peptidyl release segment (RS) capable of being cleaved by one or more mammalian proteases;
   c. the third portion comprises an extended recombinant polypeptide, wherein the extended recombinant polypeptide is capable of being released from the first portion by action of the mammalian protease on the second portion; and
   d. the assembly is a monomeric fusion protein configured, in an N- to C-terminus orientation, of binding domains- RS- extended recombinant polypeptide or extended recombinant polypeptide -RS-binding domains,
   wherein the chimeric polypeptide assembly is characterized by the ratio between 1) relative cytotoxicity and 2) relative effector-cell antigen binding affinity multiplied with relative binding affinity to the tumor specific marker, being greater than at least 3:1, wherein:
   a) relative cytotoxicity is measured as a ratio between cytotoxicity of (i) the released first portion to the target cell in an in vitro assay comprising both the effector cells bearing the effector-cell antigen and tumor cells bearing the target cell marker and (ii) a composition comprising a corresponding first portion of the chimeric polypeptide assembly and a corresponding third portion of the chimeric polypeptide assembly linked by a non-cleavable peptide of 1 to about 10 amino acids;
   b) relative effector cell antigen binding affinity, is measured as a ratio between (i) binding affinity of the released first portion to the effector cell antigen and (ii) the binding affinity of a composition comprising the corresponding first portion of the chimeric polypeptide assembly and the corresponding third portion of the chimeric polypeptide assembly linked by a non-cleavable peptide of 1 to about 10 amino acids to the effector cell antigen; and
   c) relative target-cell marker binding affinity is measured as a ratio between (i) the binding affinity of the released first portion to the target-cell marker and (ii) the binding affinity to the target-cell marker of a composition comprising the corresponding first portion of the chimeric polypeptide assembly and the corresponding third portion of the chimeric polypeptide assembly linked by a non-cleavable peptide of 1 to about 10 amino acids.

2. The chimeric polypeptide assembly of claim 1, wherein the extended recombinant polypeptide comprises an amino acid sequence selected from the amino acid sequences of SEQ ID NOs. 374-417.

3. The chimeric polypeptide assembly of claim 1, wherein the target cell marker is a tumor specific marker that is alpha 4 integrin, Ang2, B7-H3, B7-H6, CEACAM5, cMET, CTLA4, FOLR1,EpCAM, CCR5, CD19, HER2, HER2 neu, HER3, HER4, HER1 (EGFR), PD-L1, PSMA, CEA, MUC1 (mucin), MUC2, MUC3, MUC4, MUC5AC, MUC5B, MUC7, MUC16, BhCG, Lewis-Y, CD20, CD33, CD38, CD30, CD56 (NCAM), CD133, ganglioside GD3, 9-O-Acetyl-GD3, GM2, Globo H, fucosyl GM1, GD2, carbonic anhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (sTN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR1, VEGFR2, DLK1, SP17, ROR1, or EphA2.

4. The chimeric polypeptide assembly of claim 1, wherein the effector cell antigen is expressed on an effector cell selected from the group consisting of a plasma cell, T cell, B cell, cytokine induced killer cell (CIK cell), mast cell, dendritic cell, regulatory T cell (RegT cell), helper T cell, myeloid cell, and NK cell.

5. The chimeric polypeptide assembly of claim 1, wherein the effector cell antigen is CD3.

6. The chimeric polypeptide assembly of claim 1, wherein the second binding domain comprises VH and VL regions derived from a monoclonal antibody capable of binding human CD3.

7. The chimeric polypeptide assembly of claim 6, wherein the VH and VL regions derived from a monoclonal antibody capable of binding human CD3 have VL and VH sequences selected from the amino acid sequences of SEQ ID NOs. 32-41.

8. The chimeric polypeptide assembly of claim 1, wherein the first binding domain comprises VH and VL regions derived from a monoclonal antibody capable of binding the target cell marker.

9. The chimeric polypeptide assembly of claim 8, wherein the first binding domain VH and VL regions have VL and VH sequences of an anti-tumor cell antibody set forth in the amino acid sequences of SEQ ID NOs. 141-236.

10. The chimeric polypeptide assembly of claim 1, wherein the mammalian protease is expressed in a tumor tissue.

11. The chimeric polypeptide assembly of claim 1, wherein the RS comprises an amino acid sequence capable of being cleaved by a protease that is:
a metalloproteinase comprising Meprin, Neprilysin (CD10), PSMA, BMP-1, A disintegrin and metalloproteinases 8 (ADAM8), ADAM9, ADAM10, ADAM12, ADAM15, ADAM17 (TACE), ADAM19, ADAM28 (MDC-L), ADAM with thrombospondin motifs 1 (ADAMTS1), ADAMTS4, ADAMTS5, Matrix Metalloproteinase (MMP-1, Collagenase), MMP-2 (Gelatinase A), MMP-3 (Stromelysin 1), MMP-7 (Matrilysin 1), MMP-8 (Collagenase 2), MMP-9 (Gelatinase B), MMP-10 (Stromelysin 2), MMP-11(Stromelysin 3), MMP-12 (Macrophage elastase), MMP-13 (Collagenase 3), MMP-14 (MT1-MMP), MMP-15 (MT2-MMP), MMP-19, MMP-23 (CA-MMP), MMP-24 (MT5-MMP), MMP-26 (Matrilysin 2), MMP-27 (CMMP), or
a cysteine protease comprising Legumain, Cysteine Cathepsins, Cathepsin B, Cathepsin C, Cathepsin K, Cathepsin L, Cathepsin S, Cathespin X, or
an aspartate protease comprising Cathepsin D, Cathepsin E, Secretase, or
a serine protease comprising urokinase (uPA), Tissue-type plasminogen activator (tPA), Plasmin, Thrombin, Prostate-specific antigen (PSA, KLK3), Human neutrophil elastase (HNE) Elastase, Tryptase, Type II transmembrane serine proteases (TTSPs), DESC1, Hepsin (HPN), Matriptase, Matriptase-2, TMPRSS2, TMPRSS3, TMPRSS4 (CAP2), Fibroblast Activation Protein (FAP), KLK4, KLK5, KLK6, KLK7, KLK8, KLK10, KLK11, KLK13, or KLK14.

12. The chimeric polypeptide assembly of claim 11, wherein upon cleavage of the second portion and release of the first portion from the chimeric polypeptide assembly, the released first portion from the chimeric polypeptide assembly has at least 2-fold increased binding affinity to the effector cell bearing the effector cell antigen or the tumor cell marker compared to the binding affinity of the chimeric binding assembly from which the second portion has not been cleaved.

13. The chimeric polypeptide assembly of claim 12, wherein upon cleavage of the second portion by said mammalian protease and release of the first portion from the chimeric polypeptide assembly, the first portion is capable of concurrently binding to a T cell bearing the effector cell antigen and to a tumor cell bearing the tumor specific marker in an in vitro assay comprising both the effector cells and the tumor cells, wherein the concurrent binding of the first portion to the effector cell and the tumor cell yields cytotoxic activity against the tumor cell in the in vitro assay.

14. The chimeric polypeptide assembly of claim 13, wherein the amount of cell lysis effected by the released first portion of the chimeric polypeptide assembly is at least 10-fold greater than the intact chimeric binding assembly in the in vitro assay.

15. The chimeric polypeptide assembly of claim 13, wherein the cytotoxic activity against the tumor cell is mediated by target-specific activation of the effector cell.

16. The chimeric polypeptide assembly of any one of claims 13-15, wherein the in vitro assay is a cell membrane integrity assay, a mixed cell culture assay, a FACS based propidium Iodide assay, a trypan Blue influx assay, a photometric enzyme release assay, a radiometric 51Cr release assay, a fluorometric Europium release assay, a CalceinAM release assay, a photometric MTT assay, an XTT assay, a WST-1 assay, an alamar blue assay, a radiometric 3H-Thd incorporation assay, a clonogenic assay measuring cell division activity, a fluorometric rhodamine123 assay measuring mitochondrial transmembrane gradient, an apoptosis assay monitored by FACS-based phosphatidylserine exposure, an ELISA-based TUNEL test assay, a sandwich ELISA, a caspase activity assay, a cell-based LDH release assay, or a cell morphology assay, or any combination thereof.

17. The chimeric polypeptide assembly of claim 13, wherein the binding affinity of the first binding domain to the target cell, as measured by $K_d$ constant in the in vitro assay, is at least one order of magnitude greater compared to the lower binding affinity of the second binding domain to the effector cell antigen.

18. The chimeric polypeptide assembly of claim 11, further comprising a fourth portion comprising a peptidyl RS capable of being cleaved by the proteases selected from the group consisting of Meprin, Neprilysin (CD10), PSMA, BMP-1, A disintegrin and metalloproteinases (ADAMs), ADAM8, ADAM9, ADAM10, ADAM12, ADAM15, ADAM17 (TACE), ADAM19, ADAM28 (MDC-L), ADAM with thrombospondin motifs (ADAMTS), ADAMTS1, ADAMTS4, ADAMTS5, Matrix Metalloproteinases (MMPs), MMP-1 (Collagenase 1), MMP-2 (Gelatinase A), MMP-3 (Stromelysin 1), MMP-7 (Matrilysin 1), MMP-8 (Collagenase 2), MMP-9 (Gelatinase B), MMP-10 (Stromelysin 2), MMP-11(Stromelysin 3), MMP-12 (Macrophage elastase), MMP-13 (Collagenase 3), MMP-14 (MT1-MMP), MMP-15 (MT2-MMP), MMP-19, MMP-23 (CA-MMP), MMP-24 (MT5-MMP), MMP-26 (Matrilysin 2), MMP-27 (CMMP), Legumain, Cysteine Cathepsins, Cathepsin B, Cathepsin C, Cathepsin K, Cathepsin L, Cathepsin S, Cathespin X, Cathepsin D, Cathepsin E, Secretase, Urokinase (uPA), Tissue-type plasminogen activator (tPA), Plasmin, Thrombin, Prostate-specific antigen (PSA, KLK3), Human neutrophil elastase (HNE), Elastase, Tryptase, Type II transmembrane serine proteases (TTSPs), DESC1, Hepsin (HPN), Matriptase, Matriptase-2, TMPRSS2, TMPRSS3, TMPRSS4 (CAP2), Fibroblast Activation Protein (FAP), kallikrein-related peptidase (KLK family), KLK4, KLK5, KLK6, KLK7, KLK8, KLK10, KLK11, KLK13, and KLK14; and
a fifth portion comprising an extended recombinant polypeptide, wherein the extended recombinant polypeptide comprises an amino acid sequence selected from amino acid sequences of SEQ ID NOs. 374-417.

19. The chimeric polypeptide assembly of claim 18, wherein the chimeric polypeptide assembly that is intact has at least a 10-fold lower potential to effect production of a Th1 cytokine from effector cells compared to the corresponding first portion of the chimeric polypeptide assembly that is not linked to the assembly, when the chimeric polypeptide assembly and the corresponding first portion is in contact with the effector cell and a tumor cell bearing the tumor specific marker in an in vitro assay comprising both the effector cells and the tumor cells.

20. The chimeric polypeptide assembly of claim 19, wherein the Th1 cytokine is IL-2, TNF-alpha, or IFN-gamma.

21. The chimeric polypeptide assembly of claim 11, wherein following administration of a composition comprising the chimeric polypeptide assembly to a subject having a tumor, the RS of the chimeric polypeptide assembly is cleaved in proximity to a tumor by a protease capable of cleaving the RS in the tumor environment of said tumor.

22. The chimeric polypeptide assembly of claim 21, wherein upon cleavage of the RS by said mammalian protease and release of the first portion from the chimeric polypeptide assembly, the first portion is capable of concurrently binding to an effector cell bearing an effector cell antigen and to a tumor cell bearing a tumor specific marker.

23. The chimeric polypeptide assembly of claim 22, whereupon the concurrent binding to an effector cell bearing the effector cell antigen and the tumor cell bearing the tumor cell marker by the first portion results in the release of effector cell-derived effector molecules, wherein the effector molecule is selected from TNF-α, IFN-γ, interleukin 2, perforin, or granzymes.

24. The chimeric polypeptide assembly of claim 22, whereupon the concurrent binding of the first portion to an effector cell bearing the effector cell antigen and to a tumor cell bearing the tumor specific marker, lysis of the tumor cell is affected by the effector cell.

25. The chimeric polypeptide assembly of claim 21, wherein the chimeric polypeptide assembly exhibits a half-life following administration to a subject that is at least 2-fold greater than the half-life of the first portion not linked to the second and third portions after being administered to a subject at a comparable dose.

26. The chimeric polypeptide assembly of claim 21, wherein following administration of the chimeric polypeptide assembly to the subject having the tumor and cleavage of the second portion and release of the first portion and the third portion from the chimeric polypeptide assembly, the first portion has a half-life that is at least 2-fold less than the intact chimeric polypeptide assembly in the subject.

27. The chimeric polypeptide assembly of claim 21, wherein the plasma Cmax concentration of the released first portion after a single administration of a composition comprising the chimeric polypeptide assembly to the subject does not exceed about 0.01 ng/ml.

28. The chimeric polypeptide assembly of any one of claims 21-27 wherein the subject is a mouse, a rat, a monkey, a dog, or a human.

29. A chimeric fusion polypeptide in the form of a chimeric polypeptide assembly,
wherein the chimeric fusion polypeptide in the form of the chimeric polypeptide assembly is capable of being converted to an activated form upon cleavage by one or more mammalian proteases;
wherein the chimeric fusion polypeptide in the form of the chimeric polypeptide assembly comprises a first portion, a second portion, a third portion, a fourth portion, and a fifth portion;
wherein the chimeric fusion polypeptide in the form of the chimeric polypeptide assembly has a configuration from N-terminus to C-terminus of (fifth portion)-(fourth portion)-(first portion)-(second portion)-(third portion);
wherein the first portion comprises
i. a first binding domain having binding specificity to a tumor-specific marker or an antigen of a target cell and wherein the first binding domain is an scFv; and
ii. a second binding domain having binding specificity to an effector cell antigen, wherein the effector cell antigen is CD3 and wherein the second binding domain is an scFv;
wherein the second portion comprises a peptidyl release segment (RS) capable of being cleaved by one or more of the mammalian proteases selected from the group consisting of Meprin, Neprilysin (CD10), PSMA, BMP-1, A disintegrin and metalloproteinases (ADAMs), ADAM8, ADAM9, ADAM10, ADAM12, ADAM15, ADAM17 (TACE), ADAM19, ADAM28 (MDC-L), ADAM with thrombospondin motifs (ADAMTS), ADAMTS1, ADAMTS4, ADAMTS5, Matrix Metalloproteinases (MMPs), MMP-1 (Collagenase 1), MMP-2 (Gelatinase A), MMP-3 (Stromelysin 1), MMP-7 (Matrilysin 1), MMP-8 (Collagenase 2), MMP-9 (Gelatinase B), MMP-10 (Stromelysin 2), MMP-11(Stromelysin 3), MMP-12 (Macrophage elastase), MMP-13 (Collagenase 3), MMP-14 (MT1-MMP), MMP-15 (MT2-MMP), MMP-19, MMP-23 (CA-MMP), MMP-24 (MT5-MMP), MMP-26 (Matrilysin 2), MMP-27 (CMMP), Legumain, Cysteine Cathepsins, Cathepsin B, Cathepsin C, Cathepsin K, Cathepsin L, Cathepsin S, Cathespin X, Cathepsin D, Cathepsin E, Secretase, Urokinase (uPA), Tissue-type plasminogen activator (tPA), Plasmin, Thrombin, Prostate-specific antigen (PSA, KLK3), Human neutrophil elastase (HNE), Elastase, Tryptase, Type II transmembrane serine proteases (TTSPs), DESC1, Hepsin (HPN), Matriptase, Matriptase-2, TMPRSS2, TMPRSS3, TMPRSS4 (CAP2), Fibroblast Activation Protein (FAP), kallikrein-related peptidase (KLK family), KLK4, KLK5, KLK6, KLK7, KLK8, KLK10, KLK11, KLK13, and KLK14;
wherein the third portion is a bulking moiety comprising an extended recombinant polypeptide;
wherein the fourth portion comprises a peptidyl release segment (RS) capable of being cleaved by one or more of the mammalian proteases selected from the group consisting of Meprin, Neprilysin (CD10), PSMA, BMP-1, A disintegrin and metalloproteinases (ADAMs), ADAM8, ADAM9, ADAM10, ADAM12, ADAM15, ADAM17 (TACE), ADAM19, ADAM28 (MDC-L), ADAM with thrombospondin motifs (ADAMTS), ADAMTS1, ADAMTS4, ADAMTS5, Matrix Metalloproteinases (MMPs), MMP-1 (Collagenase 1), MMP-2 (Gelatinase A), MMP-3 (Stromelysin 1), MMP-7 (Matrilysin 1), MMP-8 (Collagenase 2), MMP-9 (Gelatinase B), MMP-10 (Stromelysin 2), MMP-11(Stromelysin 3), MMP-12 (Macrophage elastase), MMP-13 (Collagenase 3), MMP-14 (MT1-MMP), MMP-15 (MT2-MMP), MMP-19, MMP-23 (CA-MMP), MMP-24 (MT5-MMP), MMP-26 (Matrilysin 2), MMP-27 (CMMP), Legumain, Cysteine Cathepsins, Cathepsin B, Cathepsin C, Cathepsin K, Cathepsin L, Cathepsin S, Cathespin X, Cathepsin D, Cathepsin E, Secretase, Urokinase (uPA), Tissue-type plasminogen activator (tPA), Plasmin, Thrombin, Prostate-specific antigen (PSA, KLK3), Human neutrophil elastase (HNE), Elastase, Tryptase, Type II transmembrane serine proteases (TTSPs), DESC1, Hepsin (HPN), Matriptase, Matriptase-2, TMPRSS2, TMPRSS3, TMPRSS4 (CAP2), Fibroblast Activation Protein (FAP), kallikrein-related peptidase (KLK family), KLK4, KLK5, KLK6, KLK7, KLK8, KLK10, KLK11, KLK13, and KLK14;

wherein the fifth portion is a bulking moiety comprising an extended recombinant polypeptide;

wherein the bulking moiety of the third portion and the bulking moiety of the fifth portion of the chimeric fusion polypeptide in the form of the chimeric polypeptide assembly shield the binding domains and reduce binding affinity for the target antigens when the chimeric fusion polypeptide is in the form of the chimeric polypeptide assembly;

wherein the bulking moiety of the third portion of the chimeric fusion polypeptide in the form of the chimeric polypeptide assembly is capable of being released from the first portion of the chimeric fusion polypeptide in the form of the chimeric polypeptide assembly by action of one or more of the mammalian proteases on the second portion of the chimeric fusion polypeptide in the form of the chimeric polypeptide assembly;

wherein the bulking moiety of the fifth portion of the chimeric fusion polypeptide in the form of the chimeric polypeptide assembly is capable of being released from the first portion of the chimeric fusion polypeptide in the form of the chimeric polypeptide assembly by action of one or more of the mammalian proteases on the fourth portion of the chimeric fusion polypeptide in the form of the chimeric polypeptide assembly;

wherein upon cleavage of the RS by the protease and release of the extended recombinant polypeptide the chimeric fusion polypeptide in the form of the chimeric polypeptide assembly is converted into the activated form.

30. The chimeric fusion polypeptide of claim 29, wherein the release segment of the second portion comprises an amino acid sequence selected from the group consisting of SEQ ID NO: 243-358.

31. The chimeric fusion polypeptide of claim 29, wherein the release segment of the fourth portion comprises an amino acid sequence selected from the group consisting of SEQ ID NO: 243-358.

32. The chimeric fusion polypeptide of claim 29, wherein the extended recombinant polypeptide of the third portion comprises a sequence that has at least 90% sequence identity to a sequence selected from the group consisting of SEQ ID NO: 374-417.

33. The chimeric fusion polypeptide of claim 32, wherein the extended recombinant polypeptide of the third portion comprises a sequence that has at least 95% sequence identity to a sequence selected from the group consisting of SEQ ID NO: 374-417.

34. The chimeric fusion polypeptide of claim 29, wherein the extended recombinant polypeptide of the fifth portion comprises a sequence that has at least 90% sequence identity to a sequence selected from the group consisting of SEQ ID NO: 374-417.

35. The chimeric fusion polypeptide of claim 34, wherein the extended recombinant polypeptide of the fifth portion comprises a sequence that has at least 95% sequence identity to a sequence selected from the group consisting of SEQ ID NO: 374-417.

36. The chimeric fusion polypeptide of claim 29, wherein the first binding domain comprises VH and VL regions of a monoclonal antibody capable of binding the tumor-specific marker, wherein the tumor specific marker is alpha 4 integrin, Ang2, B7-H3, B7-H6, CEACAM5, cMET, CTLA4, FOLR1,EpCAM, CCR5, CD19, HER2, HER2 neu, HER3, HER4, HER1 (EGFR), PD-L1, PSMA, CEA, MUC1(mucin), MUC-2, MUC3, MUC4, MUC5AC, MUC5B, MUC7, MUC16, BhCG, Lewis-Y, CD20, CD33, CD38, CD30, CD56 (NCAM), CD133, ganglioside GD3; 9-O- Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR1, VEGFR2, DLK1, SP17, ROR1, or EphA2.

37. The chimeric fusion polypeptide of claim 29, wherein the first binding domain and the second binding domain are linked by a flexible polypeptide linker selected from the group consisting of SEQ ID NO: 463-476 and GGS, and GSP.

38. The chimeric fusion polypeptide of claim 29, wherein the RS of the second portion and/or the RS of the fourth portion comprises an amino acid sequence capable of being cleaved by MMP-11.

39. The chimeric fusion polypeptide of claim 29, wherein the RS of the second portion and/or the RS of the fourth portion is a substrate for at least two proteases, wherein the at least two proteases comprise MMP-2, MMP-9, uPA, or matriptase.

40. The chimeric fusion polypeptide of claim 29, wherein the RS sequence of the second portion and/or the RS of the fourth portion is engineered to be cleaved by any of a number of multiple mammalian proteases at a plurality of cleavage sites.

41. The chimeric fusion polypeptide of claim 29, wherein binding affinity of the first binding domain to the tumor-specific marker, as measured by a Ka constant in the in vitro assay, is at least one order of magnitude greater compared to lower binding affinity of the second binding domain to CD3.

42. The chimeric fusion polypeptide of claim 29, wherein the first binding domain comprises an scFv that has a VL region and a VH region, wherein the VL region is positioned N-terminal of the VH region.

43. The chimeric fusion polypeptide of claim 29, wherein the second binding domain comprises an scFv that has a VL region and a VH region, wherein the VL region is positioned N-terminal of the VH region.

44. The chimeric fusion polypeptide of claim 29, wherein the RS of the fourth portion is the same as the RS of the second portion.

45. The chimeric fusion polypeptide of claim 29, wherein the RS of the fourth portion is different from the RS of the second portion.

46. The chimeric fusion polypeptide of claim 29, wherein the bulking moiety of the fifth portion is the same as the bulking moiety of the third portion.

47. The chimeric fusion polypeptide of claim 29, wherein the bulking moiety of the fifth portion is different from the bulking moiety of the third portion.

48. A pharmaceutical composition comprising the chimeric fusion polypeptide of claim 29 and one or more pharmaceutically suitable excipients.

49. The chimeric fusion polypeptide of claim 29, wherein cell lysis is measured in an in vitro assay comprising the target cells and a population of human peripheral blood mononuclear cells (PBMCs) comprising T cells.

50. The chimeric fusion polypeptide of claim 49, wherein, in the in vitro assay:
  (a) the PBMCs are isolated from one or more healthy donors by ficoll density gradient centrifugation from either whole blood or from a lymphocyte-enriched buffy coat preparation;
  (b) the PBMCs are resuspended and cultured in RPMI-1640/10% FCS/25 mmol/mL HEPES at 37° C. in a 5% CO2 humidified incubator until use in the in vitro assay;
  (c) the cell density of the tumor cells is $2.5 \times 10^5$ cells/mL and the cell density of the PBMCs is $1 \times 10^6$ cells/mL in the in vitro assay;
  (d) the tumor cells and the PBMCs are co-cultured in assay medium comprised of phenol red-free RPMI and 5% FCS; and/or
  (e) cell lysis is measured by a lactate dehydrogenase (LDH) release assay, a caspase 3/7 assay, or FACS-based analysis.

51. The chimeric fusion polypeptide of claim 50, wherein, in the in vitro assay, an effector cell to tumor cell ratio of 5:1 is present in the assay medium.

52. A chimeric fusion polypeptide in the form of a chimeric polypeptide assembly,
  wherein the chimeric fusion polypeptide in the form of the chimeric polypeptide assembly is capable of being converted to an activated form upon cleavage by one or more mammalian proteases;
  wherein the chimeric fusion polypeptide in the form of the chimeric polypeptide assembly wherein the chimeric fusion polypeptide in the form of the chimeric polypeptide assembly comprises a first portion, a second portion, a third portion, a fourth portion, and a fifth portion;
  wherein the chimeric fusion polypeptide in the form of the chimeric polypeptide assembly has a configuration from N-terminus to C-terminus of (fifth portion)-(fourth portion)-(first portion)-(second portion)-(third portion);
  wherein the first portion comprises
    i. a first binding domain having binding specificity to a tumor-specific marker or an antigen of a target cell; and
    ii. a second binding domain having binding specificity to an effector cell antigen,
    wherein the effector cell antigen is CD3;
  wherein the second portion comprises a peptidyl release segment (RS) capable of being cleaved by one or more of the mammalian proteases selected from the group consisting of Meprin, Neprilysin (CD10), PSMA, BMP-1, A disintegrin and metalloproteinases (AD-AMs), ADAM8, ADAM9, ADAM10, ADAM12, ADAM15, ADAM17 (TACE), ADAM19, ADAM28 (MDC-L), ADAM with thrombospondin motifs (AD-AMTS), ADAMTS1, ADAMTS4, ADAMTS5, Matrix Metalloproteinases (MMPs), MMP-1 (Collagenase 1), MMP-2 (Gelatinase A), MMP-3 (Stromelysin 1), MMP-7 (Matrilysin 1), MMP-8 (Collagenase 2), MMP-9 (Gelatinase B), MMP-10 (Stromelysin 2), MMP-11(Stromelysin 3), MMP-12 (Macrophage elastase), MMP-13 (Collagenase 3), MMP-14 (MT1-MMP), MMP-15 (MT2-MMP), MMP-19, MMP-23 (CA-MMP), MMP-24 (MT5-MMP), MMP-26 (Matrilysin 2), MMP-27 (CMMP), Legumain, Cysteine Cathepsins, Cathepsin B, Cathepsin C, Cathepsin K, Cathepsin L, Cathepsin S, Cathespin X, Cathepsin D, Cathepsin E, Secretase, Urokinase (uPA), Tissue-type plasminogen activator (tPA), Plasmin, Thrombin, Prostate-specific antigen (PSA, KLK3), Human neutrophil elastase (HNE), Elastase, Tryptase, Type II transmembrane serine proteases (TTSPs), DESC1, Hepsin (HPN), Matriptase, Matriptase-2, TMPRSS2, TMPRSS3, TMPRSS4 (CAP2), Fibroblast Activation Protein (FAP), kallikrein-related peptidase (KLK family), KLK4, KLK5, KLK6, KLK7, KLK8, KLK10, KLK11, KLK13, and KLK14;
  wherein the third portion is a bulking moiety comprising an extended recombinant polypeptide;
  wherein the fourth portion comprises a peptidyl release segment (RS) capable of being cleaved by one or more of the mammalian proteases selected from the group consisting of Meprin, Neprilysin (CD10), PSMA, BMP-1, A disintegrin and metalloproteinases (AD-AMs), ADAM8, ADAM9, ADAM10, ADAM12, ADAM15, ADAM17 (TACE), ADAM19, ADAM28 (MDC-L), ADAM with thrombospondin motifs (AD-AMTS), ADAMTS1, ADAMTS4, ADAMTS5, Matrix Metalloproteinases (MMPs), MMP-1 (Collagenase 1), MMP-2 (Gelatinase A), MMP-3 (Stromelysin 1), MMP-7 (Matrilysin 1), MMP-8 (Collagenase 2), MMP-9 (Gelatinase B), MMP-10 (Stromelysin 2), MMP-11(Stromelysin 3), MMP-12 (Macrophage elastase), MMP-13 (Collagenase 3), MMP-14 (MT1-MMP), MMP-15 (MT2-MMP), MMP-19, MMP-23 (CA-MMP), MMP-24 (MT5-MMP), MMP-26 (Matrilysin 2), MMP-27 (CMMP), Legumain, Cysteine Cathepsins, Cathepsin B, Cathepsin C, Cathepsin K, Cathepsin L, Cathepsin S, Cathespin X, Cathepsin D, Cathepsin E, Secretase, Urokinase (uPA), Tissue-type plasminogen activator (tPA), Plasmin, Thrombin, Prostate-specific antigen (PSA, KLK3), Human neutrophil elastase (HNE), Elastase, Tryptase, Type II transmembrane serine proteases (TTSPs), DESC1, Hepsin (HPN), Matriptase, Matriptase-2, TMPRSS2, TMPRSS3, TMPRSS4 (CAP2), Fibroblast Activation Protein (FAP), kallikrein-related peptidase (KLK family), KLK4, KLK5, KLK6, KLK7, KLK8, KLK10, KLK11, KLK13, and KLK14;
  wherein the fifth portion is a bulking moiety comprising an extended recombinant polypeptide;
  wherein the bulking moiety of the third portion and the bulking moiety of the fifth portion of the chimeric fusion polypeptide in the form of the chimeric polypeptide assembly shield the binding domains and reduce binding affinity for the target antigens when the chimeric fusion polypeptide is in the form of the chimeric polypeptide assembly;

wherein the bulking moiety of the third portion of the chimeric fusion polypeptide in the form of the chimeric polypeptide assembly is capable of being released from the first portion of the chimeric fusion polypeptide in the form of the chimeric polypeptide assembly by action of one or more of the mammalian proteases on the second portion of the chimeric fusion polypeptide in the form of the chimeric polypeptide assembly;

wherein the bulking moiety of the fifth portion of the chimeric fusion polypeptide in the form of the chimeric polypeptide assembly is capable of being released from the first portion of the chimeric fusion polypeptide in the form of the chimeric polypeptide assembly by action of one or more of the mammalian proteases on the fourth portion of the chimeric fusion polypeptide in the form of the chimeric polypeptide assembly;

wherein upon cleavage of the RS by the protease and release of the extended recombinant polypeptide the chimeric fusion polypeptide in the form of the chimeric polypeptide assembly is converted into the activated form.

53. The chimeric fusion polypeptide of claim 52, wherein the first binding domain is an scFv, a single domain antibody, or a single domain camelid antibody.

54. The chimeric fusion polypeptide of claim 52, wherein the second binding domain is an scFv, a single domain antibody, or a single domain camelid antibody.

55. The chimeric fusion polypeptide of claim 52, wherein the release segment of the second portion and/or the fourth portion comprises an amino acid sequence selected from the group consisting of SEQ ID NO: 243-358.

56. The chimeric fusion polypeptide of claim 52, wherein the extended recombinant polypeptide of the third portion and/or the fifth portion comprises a sequence that has at least 90% sequence identity or at least 95% sequence identity to a sequence selected from the group consisting of SEQ ID NO: 374-417.

57. The chimeric fusion polypeptide of claim 52, wherein the first binding domain comprises VH and VL regions of a monoclonal antibody capable of binding the tumor-specific marker, wherein the tumor specific marker is alpha 4 integrin, Ang2, B7-H3, B7-H6, CEACAM5, cMET, CTLA4, FOLR1,EpCAM, CCR5, CD19, HER2, HER2 neu, HER3, HER4, HER1 (EGFR), PD-L1, PSMA, CEA, MUC1(mucin), MUC-2, MUC3, MUC4, MUC5AC, MUC5B, MUC7, MUC16, BhCG, Lewis-Y, CD20, CD33, CD38, CD30, CD56 (NCAM), CD133, ganglioside GD3; 9-O- Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EG-FRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR1, VEGFR2, DLK1, SP17, ROR1, or EphA2.

58. The chimeric fusion polypeptide of claim 52, wherein the first binding domain and the second binding domain are linked by a flexible polypeptide linker selected from the group consisting of SEQ ID NO: 463-476 and Table 9GGS, and GSP.

59. The chimeric fusion polypeptide of claim 52, wherein the RS of the second portion and/or the RS of the fourth portion comprises an amino acid sequence capable of being cleaved by MMP-11.

60. The chimeric fusion polypeptide of claim 52, wherein the RS of the second portion and/or the RS of the fourth portion is a substrate for at least two proteases, wherein the at least two proteases comprise MMP-2, MMP-9, uPA, or matriptase.

61. The chimeric fusion polypeptide of claim 52, wherein the RS sequence of the second portion and/or the RS of the fourth portion is engineered to be cleaved by any of a number of multiple mammalian proteases at a plurality of cleavage sites.

62. The chimeric fusion polypeptide of claim 52, wherein binding affinity of the first binding domain to the tumor-specific marker, as measured by a Ka constant in the in vitro assay, is at least one order of magnitude greater compared to lower binding affinity of the second binding domain to CD3.

63. The chimeric fusion polypeptide of claim 52, wherein the first binding domain comprises an scFv that has a VL region and a VH region, wherein the VL region is positioned N-terminal of the VH region.

64. The chimeric fusion polypeptide of claim 52, wherein the second binding domain comprises an scFv that has a VL region and a VH region, wherein the VL region is positioned N-terminal of the VH region.

65. The chimeric fusion polypeptide of claim 52, wherein the RS of the fourth portion is the same as the RS of the second portion.

66. The chimeric fusion polypeptide of claim 52, wherein the RS of the fourth portion is different from the RS of the second portion.

67. The chimeric fusion polypeptide of claim 52, wherein the bulking moiety of the fifth portion is the same as the bulking moiety of the third portion.

68. The chimeric fusion polypeptide of claim 52, wherein the bulking moiety of the fifth portion is different from the bulking moiety of the third portion.

69. A pharmaceutical composition comprising the chimeric fusion polypeptide of claim 52 and one or more pharmaceutically suitable excipients.

70. The chimeric fusion polypeptide of claim 52, wherein cell lysis is measured in an in vitro assay comprising the target cells and a population of human peripheral blood mononuclear cells (PBMCs) comprising T cells.

71. The chimeric fusion polypeptide of claim 70, wherein, in the in vitro assay:
(a) the PBMCs are isolated from one or more healthy donors by ficoll density gradient centrifugation from either whole blood or from a lymphocyte-enriched buffy coat preparation;
(b) the PBMCs are resuspended and cultured in RPMI-1640/10% FCS/25 mmol/mL HEPES at 37° C. in a 5% $CO_2$ humidified incubator until use in the in vitro assay;
(c) the cell density of the tumor cells is $2.5 \times 10^5$ cells/mL and the cell density of the PBMCs is $1 \times 10^6$ cells/mL in the in vitro assay;
(d) the tumor cells and the PBMCs are co-cultured in assay medium comprised of phenol red-free RPMI and 5% FCS; and/or (e) cell lysis is measured by a lactate dehydrogenase (LDH) release assay, a caspase 3/7 assay, or FACS-based analysis.

72. The chimeric fusion polypeptide of claim 70, wherein, in the in vitro assay, an effector cell to tumor cell ratio of 5:1 is present in the assay medium.

\* \* \* \* \*